United States Patent 11,464,842 (COMPOSITIONS AND METHOD FOR OPTIMIZED PEPTIDE VACCINES USING RESIDUE OPTIMIZATION) - sequence listing, part 3

SEQ ID NO: 26903 - protein, 18 aa, Artificial Sequence
  Description of Artificial Sequence: Synthetic peptide
  Seed: MTEYKLVVVGARGVGKSA (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGKSA

SEQ ID NO: 26904 - protein, 19 aa, Artificial Sequence
  Description of Artificial Sequence: Synthetic peptide
  Seed: MTEYKLVVVGARGVGKSAL (KRAS G12R)
  Core: KLVVVGARG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXARXVGKSAL

SEQ ID NO: 26905 - protein, 19 aa, Artificial Sequence
  Description of Artificial Sequence: Synthetic peptide
  Seed: MTEYKLVVVGARGVGKSAL (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGKSAL

SEQ ID NO: 26906 - protein, 20 aa, Artificial Sequence
  Description of Artificial Sequence: Synthetic peptide
  Seed: MTEYKLVVVGARGVGKSALT (KRAS G12R)
  Core: KLVVVGARG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXARXVGKSALT

SEQ ID NO: 26907 - protein, 20 aa, Artificial Sequence
  Description of Artificial Sequence: Synthetic peptide
  Seed: MTEYKLVVVGARGVGKSALT (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGKSALT

SEQ ID NO: 26908 - protein, 21 aa, Artificial Sequence
  Description of Artificial Sequence: Synthetic peptide
  Seed: MTEYKLVVVGARGVGKSALTI (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGKSALTI

SEQ ID NO: 26909 - protein, 22 aa, Artificial Sequence
  Description of Artificial Sequence: Synthetic peptide
  Seed: MTEYKLVVVGARGVGKSALTIQ (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGKSALTIQ

SEQ ID NO: 26910 - protein, 23 aa, Artificial Sequence
  Description of Artificial Sequence: Synthetic peptide
  Seed: MTEYKLVVVGARGVGKSALTIQL (KRAS G12R)
  Core: KLVVVGARG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, or Trp
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Ser, Thr, Val, Trp, or Tyr
MTEYXLVXVXARXVGKSALTIQL

SEQ ID NO: 26911 - protein, 23 aa, Artificial Sequence
  Description of Artificial Sequence: Synthetic peptide
  Seed: MTEYKLVVVGARGVGKSALTIQL (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGKSALTIQL

SEQ ID NO: 26912 - protein, 24 aa, Artificial Sequence
  Description of Artificial Sequence: Synthetic peptide
  Seed: MTEYKLVVVGARGVGKSALTIQLI (KRAS G12R)
  Core: KLVVVGARG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, or Trp
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Ser, Thr, Val, Trp, or Tyr
MTEYXLVXVXARXVGKSALTIQLI

SEQ ID NO: 26913 - protein, 24 aa, Artificial Sequence
  Description of Artificial Sequence: Synthetic peptide
  Seed: MTEYKLVVVGARGVGKSALTIQLI (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGKSALTIQLI

SEQ ID NO: 26914 - protein, 25 aa, Artificial Sequence
  Description of Artificial Sequence: Synthetic peptide
  Seed: MTEYKLVVVGARGVGKSALTIQLIQ (KRAS G12R)
  Core: KLVVVGARG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, or Trp
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Ser, Thr, Val, Trp, or Tyr
MTEYXLVXVXARXVGKSALTIQLIQ

SEQ ID NO: 26915 - protein, 25 aa, Artificial Sequence
  Description of Artificial Sequence: Synthetic peptide
  Seed: MTEYKLVVVGARGVGKSALTIQLIQ (KRAS G12R)
  Core: LVVVGARGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXRGXGKSALTIQLIQ

SEQ ID NO: 26916 - protein, 13 aa, Artificial Sequence
  Description of Artificial Sequence: Synthetic peptide
  Seed: TEYKLVVVGARGV (KRAS G12R)
  Core: LVVVGARGV
  misc_feature (5)..(5): Xaa can be Cys, Phe, Ile, Leu, Met, Asn, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGX

SEQ ID NO: 26917 - protein, 14 aa, Artificial Sequence
  Description of Artificial Sequence: Synthetic peptide
  Seed: TEYKLVVVGARGVG (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXG

SEQ ID NO: 26918 - protein, 15 aa, Artificial Sequence
  Description of Artificial Sequence: Synthetic peptide
  Seed: TEYKLVVVGARGVGK (KRAS G12R)
  Core: KLVVVGARG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXARXVGK

SEQ ID NO: 26919 - protein, 15 aa, Artificial Sequence
  Description of Artificial Sequence: Synthetic peptide
  Seed: TEYKLVVVGARGVGK (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGK

SEQ ID NO: 26920 - protein, 16 aa, Artificial Sequence
  Description of Artificial Sequence: Synthetic peptide
  Seed: TEYKLVVVGARGVGKS (KRAS G12R)
  Core: KLVVVGARG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXARXVGKS

SEQ ID NO: 26921 - protein, 16 aa, Artificial Sequence
  Description of Artificial Sequence: Synthetic peptide
  Seed: TEYKLVVVGARGVGKS (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKS

SEQ ID NO: 26922 - protein, 17 aa, Artificial Sequence
  Description of Artificial Sequence: Synthetic peptide
  Seed: TEYKLVVVGARGVGKSA (KRAS G12R)
  Core: KLVVVGARG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXARXVGKSA

SEQ ID NO: 26923 - protein, 17 aa, Artificial Sequence
  Description of Artificial Sequence: Synthetic peptide
  Seed: TEYKLVVVGARGVGKSA (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKSA

SEQ ID NO: 26924 - protein, 18 aa, Artificial Sequence
  Description of Artificial Sequence: Synthetic peptide
  Seed: TEYKLVVVGARGVGKSAL (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKSAL

SEQ ID NO: 26925 - protein, 19 aa, Artificial Sequence
  Description of Artificial Sequence: Synthetic peptide
  Seed: TEYKLVVVGARGVGKSALT (KRAS G12R)
  Core: KLVVVGARG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXARXVGKSALT

SEQ ID NO: 26926 - protein, 19 aa, Artificial Sequence
  Description of Artificial Sequence: Synthetic peptide
  Seed: TEYKLVVVGARGVGKSALT (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKSALT

SEQ ID NO: 26927 - protein, 20 aa, Artificial Sequence
  Description of Artificial Sequence: Synthetic peptide
  Seed: TEYKLVVVGARGVGKSALTI (KRAS G12R)
  Core: KLVVVGARG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXARXVGKSALTI

SEQ ID NO: 26928 - protein, 20 aa, Artificial Sequence
  Description of Artificial Sequence: Synthetic peptide
  Seed: TEYKLVVVGARGVGKSALTI (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKSALTI

SEQ ID NO: 26929 - protein, 21 aa, Artificial Sequence
  Description of Artificial Sequence: Synthetic peptide
  Seed: TEYKLVVVGARGVGKSALTIQ (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKSALTIQ

SEQ ID NO: 26930 - protein, 22 aa, Artificial Sequence
  Description of Artificial Sequence: Synthetic peptide
  Seed: TEYKLVVVGARGVGKSALTIQL (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKSALTIQL

SEQ ID NO: 26931 - protein, 23 aa, Artificial Sequence
  Description of Artificial Sequence: Synthetic peptide
  Seed: TEYKLVVVGARGVGKSALTIQLI (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKSALTIQLI

SEQ ID NO: 26932 - protein, 23 aa, Artificial Sequence
  Description of Artificial Sequence: Synthetic peptide
  Seed: TEYKLVVVGARGVGKSALTIQLI (KRAS G12R)
  Core: ARGVGKSAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLVVVGXRGXGXSAXTIQLI

SEQ ID NO: 26933 - protein, 24 aa, Artificial Sequence
  Description of Artificial Sequence: Synthetic peptide
  Seed: TEYKLVVVGARGVGKSALTIQLIQ (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKSALTIQLIQ

SEQ ID NO: 26934 - protein, 24 aa, Artificial Sequence
  Description of Artificial Sequence: Synthetic peptide
  Seed: TEYKLVVVGARGVGKSALTIQLIQ (KRAS G12R)
  Core: ARGVGKSAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLVVVGXRGXGXSAXTIQLIQ

SEQ ID NO: 26935 - protein, 25 aa, Artificial Sequence
  Description of Artificial Sequence: Synthetic peptide
  Seed: TEYKLVVVGARGVGKSALTIQLIQN (KRAS G12R)
  Core: LVVVGARGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXRGXGKSALTIQLIQN

SEQ ID NO: 26936 - protein, 15 aa, Artificial Sequence
  Description of Artificial Sequence: Synthetic peptide
  Seed: VVGARGVGKSALTIQ (KRAS G12R)
  Core: ARGVGKSAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXRGXGXSAXTIQ

SEQ ID NO: 26937 - protein, 16 aa, Artificial Sequence
  Description of Artificial Sequence: Synthetic peptide
  Seed: VVGARGVGKSALTIQL (KRAS G12R)
  Core: ARGVGKSAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXRGXGXSAXTIQL

SEQ ID NO: 26938 - protein, 17 aa, Artificial Sequence
  Description of Artificial Sequence: Synthetic peptide
  Seed: VVGARGVGKSALTIQLI (KRAS G12R)
  Core: ARGVGKSAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXRGXGXSAXTIQLI

SEQ ID NO: 26939 - protein, 14 aa, Artificial Sequence
  Description of Artificial Sequence: Synthetic peptide
  Seed: VVVGARGVGKSALT (KRAS G12R)
  Core: GARGVGKSA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVVXARXVXKSXLT

SEQ ID NO: 26940 - protein, 15 aa, Artificial Sequence
  Description of Artificial Sequence: Synthetic peptide
  Seed: VVVGARGVGKSALTI (KRAS G12R)
  Core: GARGVGKSA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVVXARXVXKSXLTI

SEQ ID NO: 26941 - protein, 15 aa, Artificial Sequence
  Description of Artificial Sequence: Synthetic peptide
  Seed: VVVGARGVGKSALTI (KRAS G12R)
  Core: ARGVGKSAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVVGXRGXGXSAXTI

SEQ ID NO: 26942 - protein, 16 aa, Artificial Sequence
  Description of Artificial Sequence: Synthetic peptide
  Seed: VVVGARGVGKSALTIQ (KRAS G12R)
  Core: ARGVGKSAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVVGXRGXGXSAXTIQ

SEQ ID NO: 26943 - protein, 17 aa, Artificial Sequence
  Description of Artificial Sequence: Synthetic peptide
  Seed: VVVGARGVGKSALTIQL (KRAS G12R)
  Core: ARGVGKSAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVVGXRGXGXSAXTIQL

SEQ ID NO: 26944 - protein, 22 aa, Artificial Sequence
  Description of Artificial Sequence: Synthetic peptide
  Seed: VVVGARGVGKSALTIQLIQNHF (KRAS G12R)
  Core: ARGVGKSAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVVGXRGXGXSAXTIQLIQNHF

SEQ ID NO: 26945 - protein, 13 aa, Artificial Sequence
  Description of Artificial Sequence: Synthetic peptide
  Seed: YKLVVVGARGVGK (KRAS G12R)
  Core: LVVVGARGV
  misc_feature (3)..(3): Xaa can be Ala, Cys, Phe, His, Ile, Leu, Met, Asn, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGK

SEQ ID NO: 26946 - protein, 14 aa, Artificial Sequence
  Description of Artificial Sequence: Synthetic peptide
  Seed: YKLVVVGARGVGKS (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKS

SEQ ID NO: 26947 - protein, 15 aa, Artificial Sequence
  Description of Artificial Sequence: Synthetic peptide
  Seed: YKLVVVGARGVGKSA (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSA

SEQ ID NO: 26948 - protein, 15 aa, Artificial Sequence
  Description of Artificial Sequence: Synthetic peptide
  Seed: YKLVVVGARGVGKSA (KRAS G12R)
  Core: VVGARGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXRXVGXSA

SEQ ID NO: 26949 - protein, 16 aa, Artificial Sequence
  Description of Artificial Sequence: Synthetic peptide
  Seed: YKLVVVGARGVGKSAL (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSAL

SEQ ID NO: 26950 - protein, 16 aa, Artificial Sequence
  Description of Artificial Sequence: Synthetic peptide
  Seed: YKLVVVGARGVGKSAL (KRAS G12R)
  Core: VVGARGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXRXVGXSAL

SEQ ID NO: 26951 - protein, 17 aa, Artificial Sequence
  Description of Artificial Sequence: Synthetic peptide
  Seed: YKLVVVGARGVGKSALT (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSALT

SEQ ID NO: 26952 - protein, 17 aa, Artificial Sequence
  Description of Artificial Sequence: Synthetic peptide
  Seed: YKLVVVGARGVGKSALT (KRAS G12R)
  Core: VVGARGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXRXVGXSALT

SEQ ID NO: 26953 - protein, 17 aa, Artificial Sequence
  Description of Artificial Sequence: Synthetic peptide
  Seed: YKLVVVGARGVGKSALT (KRAS G12R)
  Core: ARGVGKSAL
  misc_feature (8)..(8): Xaa can be Ala, Phe, Ile, Lys, Leu, Met, Arg, Ser, Thr, Val, Trp, or Tyr
  misc_feature (11)..(11): Xaa can be Ala, Glu, Phe, His, Ile, Leu, Met, Asn, Gln, Ser, Thr, Val, Trp, or Tyr
  misc_feature (13)..(13): Xaa can be Ala, Phe, His, Ile, Lys, Leu, Met, Pro, Arg, Ser, Thr, Val, or Tyr
  misc_feature (16)..(16): Xaa can be Ala, Asp, Glu, Phe, His, Ile, Lys, Leu, Met, Asn, Pro, Gln, Arg, Ser, Thr, Val, Trp, or Ty r
YKLVVVGXRGXGXSAXT

SEQ ID NO: 26954 - protein, 18 aa, Artificial Sequence
  Description of Artificial Sequence: Synthetic peptide
  Seed: YKLVVVGARGVGKSALTI (KRAS G12R)
  Core: LVVVGARGV
  misc_feature (3)..(3): Xaa can be Ala, Cys, Asp, Glu, Phe, His, Ile, Leu, Met, Asn, Pro, Gln, Arg, Ser, Thr, Val, Trp, or Ty r
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSALTI

SEQ ID NO: 26955 - protein, 18 aa, Artificial Sequence
  Description of Artificial Sequence: Synthetic peptide
  Seed: YKLVVVGARGVGKSALTI (KRAS G12R)
  Core: VVGARGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXRXVGXSALTI

SEQ ID NO: 26956 - protein, 19 aa, Artificial Sequence
  Description of Artificial Sequence: Synthetic peptide
  Seed: YKLVVVGARGVGKSALTIQ (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSALTIQ

SEQ ID NO: 26957 - protein, 19 aa, Artificial Sequence
  Description of Artificial Sequence: Synthetic peptide
  Seed: YKLVVVGARGVGKSALTIQ (KRAS G12R)
  Core: VVGARGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXRXVGXSALTIQ

SEQ ID NO: 26958 - protein, 20 aa, Artificial Sequence
  Description of Artificial Sequence: Synthetic peptide
  Seed: YKLVVVGARGVGKSALTIQL (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSALTIQL

SEQ ID NO: 26959 - protein, 20 aa, Artificial Sequence
  Description of Artificial Sequence: Synthetic peptide
  Seed: YKLVVVGARGVGKSALTIQL (KRAS G12R)
  Core: VVGARGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXRXVGXSALTIQL

SEQ ID NO: 26960 - protein, 20 aa, Artificial Sequence
  Description of Artificial Sequence: Synthetic peptide
  Seed: YKLVVVGARGVGKSALTIQL (KRAS G12R)
  Core: ARGVGKSAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKLVVVGXRGXGXSAXTIQL

SEQ ID NO: 26961 - protein, 21 aa, Artificial Sequence
  Description of Artificial Sequence: Synthetic peptide
  Seed: YKLVVVGARGVGKSALTIQLI (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSALTIQLI

SEQ ID NO: 26962 - protein, 21 aa, Artificial Sequence
  Description of Artificial Sequence: Synthetic peptide
  Seed: YKLVVVGARGVGKSALTIQLI (KRAS G12R)
  Core: ARGVGKSAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKLVVVGXRGXGXSAXTIQLI

SEQ ID NO: 26963 - protein, 22 aa, Artificial Sequence
  Description of Artificial Sequence: Synthetic peptide
  Seed: YKLVVVGARGVGKSALTIQLIQ (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSALTIQLIQ

SEQ ID NO: 26964 - protein, 22 aa, Artificial Sequence
  Description of Artificial Sequence: Synthetic peptide
  Seed: YKLVVVGARGVGKSALTIQLIQ (KRAS G12R)
  Core: ARGVGKSAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKLVVVGXRGXGXSAXTIQLIQ

SEQ ID NO: 26965 - protein, 23 aa, Artificial Sequence
  Description of Artificial Sequence: Synthetic peptide
  Seed: YKLVVVGARGVGKSALTIQLIQN (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSALTIQLIQN

SEQ ID NO: 26966 - protein, 24 aa, Artificial Sequence
  Description of Artificial Sequence: Synthetic peptide
  Seed: YKLVVVGARGVGKSALTIQLIQNH (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSALTIQLIQNH

SEQ ID NO: 26967 - protein, 25 aa, Artificial Sequence
  Description of Artificial Sequence: Synthetic peptide
  Seed: YKLVVVGARGVGKSALTIQLIQNHF (KRAS G12R)
  Core: LVVVGARGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXRGXGKSALTIQLIQNHF

SEQ ID NO: 26968 - protein, 13 aa, Artificial Sequence
  Description of Artificial Sequence: Synthetic peptide
  Seed: EYKLVVVGASGVG (KRAS G12S)
  Core: LVVVGASGV
  misc_feature (4)..(4): Xaa can be Ala, Cys, Glu, Phe, His, Ile, Leu, Met, Asn, Pro, Gln, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXG

SEQ ID NO: 26969 - protein, 14 aa, Artificial Sequence
  Description of Artificial Sequence: Synthetic peptide
  Seed: EYKLVVVGASGVGK (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGK

SEQ ID NO: 26970 - protein, 15 aa, Artificial Sequence
  Description of Artificial Sequence: Synthetic peptide
  Seed: EYKLVVVGASGVGKS (KRAS G12S)
  Core: KLVVVGASG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EYXLVXVXASXVGKS

SEQ ID NO: 26971 - protein, 15 aa, Artificial Sequence
  Description of Artificial Sequence: Synthetic peptide
  Seed: EYKLVVVGASGVGKS (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKS

SEQ ID NO: 26972 - protein, 16 aa, Artificial Sequence
  Description of Artificial Sequence: Synthetic peptide
  Seed: EYKLVVVGASGVGKSA (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSA

SEQ ID NO: 26973 - protein, 17 aa, Artificial Sequence
  Description of Artificial Sequence: Synthetic peptide
  Seed: EYKLVVVGASGVGKSAL (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSAL

SEQ ID NO: 26974 - protein, 18 aa, Artificial Sequence
  Description of Artificial Sequence: Synthetic peptide
  Seed: EYKLVVVGASGVGKSALT (KRAS G12S)
  Core: LVVVGASGV
  misc_feature (4)..(4): Xaa can be Ala, Cys, Glu, Phe, His, Ile, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSALT

SEQ ID NO: 26975 - protein, 19 aa, Artificial Sequence
  Description of Artificial Sequence: Synthetic peptide
  Seed: EYKLVVVGASGVGKSALTI (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSALTI

SEQ ID NO: 26976 - protein, 20 aa, Artificial Sequence
  Description of Artificial Sequence: Synthetic peptide
  Seed: EYKLVVVGASGVGKSALTIQ (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSALTIQ

SEQ ID NO: 26977 - protein, 21 aa, Artificial Sequence
  Description of Artificial Sequence: Synthetic peptide
  Seed: EYKLVVVGASGVGKSALTIQL (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSALTIQL

SEQ ID NO: 26978 - protein, 22 aa, Artificial Sequence
  Description of Artificial Sequence: Synthetic peptide
  Seed: EYKLVVVGASGVGKSALTIQLI (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSALTIQLI

SEQ ID NO: 26979 - protein, 23 aa, Artificial Sequence
  Description of Artificial Sequence: Synthetic peptide
  Seed: EYKLVVVGASGVGKSALTIQLIQ (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSALTIQLIQ

SEQ ID NO: 26980 - protein, 24 aa, Artificial Sequence
  Description of Artificial Sequence: Synthetic peptide
  Seed: EYKLVVVGASGVGKSALTIQLIQN (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSALTIQLIQN

SEQ ID NO: 26981 - protein, 25 aa, Artificial Sequence
  Description of Artificial Sequence: Synthetic peptide
  Seed: EYKLVVVGASGVGKSALTIQLIQNH (KRAS G12S)
  Core: LVVVGASGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXSGXGKSALTIQLIQNH

SEQ ID NO: 26982 - protein, 13 aa, Artificial Sequence
  Description of Artificial Sequence: Synthetic peptide
  Seed: KLVVVGASGVGKS (KRAS G12S)
  Core: LVVVGASGV
  misc_feature (2)..(2): Xaa can be Cys, Phe, Ile, Leu, Met, Val, Trp, or Tyr
  misc_feature (5)..(5): Xaa can be Ala, Cys, Glu, Phe, Gly, His, Ile, Lys, Leu, Met, Asn, Gln, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKS

SEQ ID NO: 26983 - protein, 14 aa, Artificial Sequence
  Description of Artificial Sequence: Synthetic peptide
  Seed: KLVVVGASGVGKSA (KRAS G12S)
  Core: LVVVGASGV
  misc_feature (2)..(2): Xaa can be Cys, Phe, His, Ile, Leu, Met, Gln, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKSA

SEQ ID NO: 26984 - protein, 15 aa, Artificial Sequence
  Description of Artificial Sequence: Synthetic peptide
  Seed: KLVVVGASGVGKSAL (KRAS G12S)
  Core: LVVVGASGV
  misc_feature (2)..(2): Xaa can be Ala, Cys, Phe, His, Ile, Lys, Leu, Met, Asn, Pro, Gln, Arg, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKSAL

SEQ ID NO: 26985 - protein, 15 aa, Artificial Sequence
  Description of Artificial Sequence: Synthetic peptide
  Seed: KLVVVGASGVGKSAL (KRAS G12S)
  Core: VVGASGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXSXVGXSAL

SEQ ID NO: 26986 - protein, 16 aa, Artificial Sequence
  Description of Artificial Sequence: Synthetic peptide
  Seed: KLVVVGASGVGKSALT (KRAS G12S)
  Core: LVVVGASGV
  misc_feature (2)..(2): Xaa can be Ala, Cys, Phe, His, Ile, Leu, Met, Asn, Gln, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKSALT

SEQ ID NO: 26987 - protein, 16 aa, Artificial Sequence
  Description of Artificial Sequence: Synthetic peptide
  Seed: KLVVVGASGVGKSALT (KRAS G12S)
  Core: VVGASGVGK
  misc_feature (4)..(4): Xaa can be Ala, Cys, Asp, Glu, Phe, Gly, His, Ile, Lys, Leu, Met, Asn, Pro, Gln, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXSXVGXSALT

SEQ ID NO: 26988 - protein, 17 aa, Artificial Sequence
  Description of Artificial Sequence: Synthetic peptide
  Seed: KLVVVGASGVGKSALTI (KRAS G12S)
  Core: LVVVGASGV
  misc_feature (2)..(2): Xaa can be Ala, Cys, Phe, His, Ile, Leu, Met, Asn, Gln, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKSALTI

SEQ ID NO: 26989 - protein, 17 aa, Artificial Sequence
  Description of Artificial Sequence: Synthetic peptide
  Seed: KLVVVGASGVGKSALTI (KRAS G12S)
  Core: VVGASGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXSXVGXSALTI

SEQ ID NO: 26990 - protein, 19 aa, Artificial Sequence
  Description of Artificial Sequence: Synthetic peptide
  Seed: KLVVVGASGVGKSALTIQL (KRAS G12S)
  Core: LVVVGASGV
  misc_feature (2)..(2): Xaa can be Ala, Cys, Phe, His, Ile, Leu, Met, Asn, Pro, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKSALTIQL

SEQ ID NO: 26991 - protein, 20 aa, Artificial Sequence
  Description of Artificial Sequence: Synthetic peptide
  Seed: KLVVVGASGVGKSALTIQLI (KRAS G12S)
  Core: LVVVGASGV
  misc_feature (2)..(2): Xaa can be Ala, Cys, Asp, Glu, Phe, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKSALTIQLI

SEQ ID NO: 26992 - protein, 20 aa, Artificial Sequence
  Description of Artificial Sequence: Synthetic peptide
  Seed: KLVVVGASGVGKSALTIQLI (KRAS G12S)
  Core: VVGASGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXSXVGXSALTIQLI

SEQ ID NO: 26993 - protein, 21 aa, Artificial Sequence
  Description of Artificial Sequence: Synthetic peptide
  Seed: KLVVVGASGVGKSALTIQLIQ (KRAS G12S)
  Core: LVVVGASGV
  misc_feature (2)..(2): Xaa can be Ala, Cys, Asp, Glu, Phe, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKSALTIQLIQ

SEQ ID NO: 26994 - protein, 22 aa, Artificial Sequence
  Description of Artificial Sequence: Synthetic peptide
  Seed: KLVVVGASGVGKSALTIQLIQN (KRAS G12S)
  Core: LVVVGASGV
  misc_feature (2)..(2): Xaa can be Ala, Cys, Asp, Glu, Phe, His, Ile, Leu, Met, Asn, Pro, Gln, Arg, Ser, Thr, Val, Trp, or Ty r
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKSALTIQLIQN

SEQ ID NO: 26995 - protein, 23 aa, Artificial Sequence
  Description of Artificial Sequence: Synthetic peptide
  Seed: KLVVVGASGVGKSALTIQLIQNH (KRAS G12S)
  Core: LVVVGASGV
  misc_feature (2)..(2): Xaa can be Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Ser, Thr, Val, Trp, or Ty r
  misc_feature (7)..(7): Xaa can be Ala, Cys, Asp, Glu, Gly, His, Ile, Lys, Leu, Met, Asn, Pro, Gln, Arg, Ser, Thr, or Val
  misc_feature (10)..(10): Xaa can be Ala, Asp, Glu, Phe, Gly, His, Ile, Lys, Leu, Met, Asn, Pro, Gln, Arg, Ser, Thr, Val, Trp, or Tyr
KXVVXGXSGXGKSALTIQLIQNH

SEQ ID NO: 26996 - protein, 23 aa, Artificial Sequence
  Description of Artificial Sequence: Synthetic peptide
  Seed: KLVVVGASGVGKSALTIQLIQNH (KRAS G12S)
  Core: VVGASGVGK
  misc_feature (4)..(4): Xaa can be Ala, Cys, Glu, Phe, His, Ile, Leu, Met, Asn, Pro, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXSXVGXSALTIQLIQNH

SEQ ID NO: 26997 - protein, 24 aa, Artificial Sequence
  Description of Artificial Sequence: Synthetic peptide
  Seed: KLVVVGASGVGKSALTIQLIQNHF (KRAS G12S)
  Core: LVVVGASGV
  misc_feature (2)..(2): Xaa can be Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Ser, Thr, Val, Trp, or Ty r
  misc_feature (7)..(7): Xaa can be Ala, Cys, Asp, Glu, Gly, His, Ile, Lys, Leu, Met, Asn, Pro, Gln, Arg, Ser, Thr, or Val
  misc_feature (10)..(10): Xaa can be Ala, Asp, Glu, Phe, Gly, His, Ile, Lys, Leu, Met, Asn, Pro, Gln, Arg, Ser, Thr, Val, Trp, or Tyr
KXVVXGXSGXGKSALTIQLIQNHF

SEQ ID NO: 26998 - protein, 24 aa, Artificial Sequence
  Description of Artificial Sequence: Synthetic peptide
  Seed: KLVVVGASGVGKSALTIQLIQNHF (KRAS G12S)
  Core: VVGASGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXSXVGXSALTIQLIQNHF

SEQ ID NO: 26999 - protein, 25 aa, Artificial Sequence
  Description of Artificial Sequence: Synthetic peptide
  Seed: KLVVVGASGVGKSALTIQLIQNHFV (KRAS G12S)
  Core: LVVVGASGV
  misc_feature (2)..(2): Xaa can be Cys, Phe, Ile, Lys, Leu, Met, Arg, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXSGXGKSALTIQLIQNHFV

SEQ ID NO: 27000 - protein, 14 aa, Artificial Sequence
  Description of Artificial Sequence: Synthetic peptide
  Seed: LVVVGASGVGKSAL (KRAS G12S)
  Core: VVGASGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXSXVGXSAL

SEQ ID NO: 27001 - protein, 15 aa, Artificial Sequence
  Description of Artificial Sequence: Synthetic peptide
  Seed: LVVVGASGVGKSALT (KRAS G12S)
  Core: VVGASGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXSXVGXSALT

SEQ ID NO: 27002 - protein, 16 aa, Artificial Sequence
  Description of Artificial Sequence: Synthetic peptide
  Seed: LVVVGASGVGKSALTI (KRAS G12S)
  Core: VVGASGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, Val, or Tr p
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXSXVGXSALTI

SEQ ID NO: 27003 - protein, 17 aa, Artificial Sequence
  Description of Artificial Sequence: Synthetic peptide
  Seed: LVVVGASGVGKSALTIQ (KRAS G12S)
  Core: VVGASGVGK
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Lys, Asn, Pro, Gln, Arg, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXSXVGXSALTIQ

SEQ ID NO: 27004 - protein, 14 aa, Artificial Sequence
  Description of Artificial Sequence: Synthetic peptide
  Seed: MTEYKLVVVGASGV (KRAS G12S)
  Core: LVVVGASGV
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
MTEYKXVVXGXSGX

SEQ ID NO: 27005 - protein, 15 aa, Artificial Sequence
  Description of Artificial Sequence: Synthetic peptide
  Seed: MTEYKLVVVGASGVG (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXG

SEQ ID NO: 27006 - protein, 16 aa, Artificial Sequence
  Description of Artificial Sequence: Synthetic peptide
  Seed: MTEYKLVVVGASGVGK (KRAS G12S)
  Core: KLVVVGASG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXASXVGK

SEQ ID NO: 27007 - protein, 16 aa, Artificial Sequence
  Description of Artificial Sequence: Synthetic peptide
  Seed: MTEYKLVVVGASGVGK (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGK

SEQ ID NO: 27008 - protein, 17 aa, Artificial Sequence
  Description of Artificial Sequence: Synthetic peptide
  Seed: MTEYKLVVVGASGVGKS (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGKS

SEQ ID NO: 27009 - protein, 18 aa, Artificial Sequence
  Description of Artificial Sequence: Synthetic peptide
  Seed: MTEYKLVVVGASGVGKSA (KRAS G12S)
  Core: LVVVGASGV
  misc_feature (6)..(6): Xaa can be Ala, Cys, Asp, Glu, Phe, His, Ile, Leu, Met, Asn, Pro, Gln, Arg, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGKSA

SEQ ID NO: 27010 - protein, 19 aa, Artificial Sequence
  Description of Artificial Sequence: Synthetic peptide
  Seed: MTEYKLVVVGASGVGKSAL (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGKSAL

SEQ ID NO: 27011 - protein, 20 aa, Artificial Sequence
  Description of Artificial Sequence: Synthetic peptide
  Seed: MTEYKLVVVGASGVGKSALT (KRAS G12S)
  Core: KLVVVGASG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXASXVGKSALT

SEQ ID NO: 27012 - protein, 20 aa, Artificial Sequence
  Description of Artificial Sequence: Synthetic peptide
  Seed: MTEYKLVVVGASGVGKSALT (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGKSALT

SEQ ID NO: 27013 - protein, 21 aa, Artificial Sequence
  Description of Artificial Sequence: Synthetic peptide
  Seed: MTEYKLVVVGASGVGKSALTI (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGKSALTI

SEQ ID NO: 27014 - protein, 22 aa, Artificial Sequence
  Description of Artificial Sequence: Synthetic peptide
  Seed: MTEYKLVVVGASGVGKSALTIQ (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGKSALTIQ

SEQ ID NO: 27015 - protein, 23 aa, Artificial Sequence
  Description of Artificial Sequence: Synthetic peptide
  Seed: MTEYKLVVVGASGVGKSALTIQL (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGKSALTIQL

SEQ ID NO: 27016 - protein, 24 aa, Artificial Sequence
  Description of Artificial Sequence: Synthetic peptide
  Seed: MTEYKLVVVGASGVGKSALTIQLI (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGKSALTIQLI

SEQ ID NO: 27017 - protein, 25 aa, Artificial Sequence
  Description of Artificial Sequence: Synthetic peptide
  Seed: MTEYKLVVVGASGVGKSALTIQLIQ (KRAS G12S)
  Core: LVVVGASGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXSGXGKSALTIQLIQ

SEQ ID NO: 27018 - protein, 13 aa, Artificial Sequence
  Description of Artificial Sequence: Synthetic peptide
  Seed: TEYKLVVVGASGV (KRAS G12S)
  Core: LVVVGASGV
  misc_feature (5)..(5): Xaa can be Phe, Ile, Leu, Met, Val, Trp, or Tyr
  misc_feature (8)..(8): Xaa can be Ala, Cys, Asp, Phe, Gly, His, Ile, Leu, Met, Asn, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Phe, His, Ile, Lys, Leu, Met, Asn, Gln, Arg, Ser, Thr, Val, Trp, or Tyr
TEYKXVVXGXSGX

SEQ ID NO: 27019 - protein, 14 aa, Artificial Sequence
  Description of Artificial Sequence: Synthetic peptide
  Seed: TEYKLVVVGASGVG (KRAS G12S)
  Core: LVVVGASGV
  misc_feature (5)..(5): Xaa can be Ala, Cys, Phe, Gly, His, Ile, Lys, Leu, Met, Asn, Pro, Gln, Arg, Ser, Thr, Val, Trp, or Ty r
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXG

SEQ ID NO: 27020 - protein, 15 aa, Artificial Sequence
  Description of Artificial Sequence: Synthetic peptide
  Seed: TEYKLVVVGASGVGK (KRAS G12S)
  Core: KLVVVGASG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXASXVGK

SEQ ID NO: 27021 - protein, 15 aa, Artificial Sequence
  Description of Artificial Sequence: Synthetic peptide
  Seed: TEYKLVVVGASGVGK (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGK

SEQ ID NO: 27022 - protein, 16 aa, Artificial Sequence
  Description of Artificial Sequence: Synthetic peptide
  Seed: TEYKLVVVGASGVGKS (KRAS G12S)
  Core: KLVVVGASG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXASXVGKS

SEQ ID NO: 27023 - protein, 16 aa, Artificial Sequence
  Description of Artificial Sequence: Synthetic peptide
  Seed: TEYKLVVVGASGVGKS (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKS

SEQ ID NO: 27024 - protein, 17 aa, Artificial Sequence
  Description of Artificial Sequence: Synthetic peptide
  Seed: TEYKLVVVGASGVGKSA (KRAS G12S)
  Core: KLVVVGASG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXASXVGKSA

SEQ ID NO: 27025 - protein, 17 aa, Artificial Sequence
  Description of Artificial Sequence: Synthetic peptide
  Seed: TEYKLVVVGASGVGKSA (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKSA

SEQ ID NO: 27026 - protein, 18 aa, Artificial Sequence
  Description of Artificial Sequence: Synthetic peptide
  Seed: TEYKLVVVGASGVGKSAL (KRAS G12S)
  Core: LVVVGASGV
  misc_feature (5)..(5): Xaa can be Ala, Cys, Glu, Phe, His, Ile, Lys, Leu, Met, Asn, Pro, Gln, Arg, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKSAL

SEQ ID NO: 27027 - protein, 19 aa, Artificial Sequence
  Description of Artificial Sequence: Synthetic peptide
  Seed: TEYKLVVVGASGVGKSALT (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKSALT

SEQ ID NO: 27028 - protein, 20 aa, Artificial Sequence
  Description of Artificial Sequence: Synthetic peptide
  Seed: TEYKLVVVGASGVGKSALTI (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKSALTI

SEQ ID NO: 27029 - protein, 21 aa, Artificial Sequence
  Description of Artificial Sequence: Synthetic peptide
  Seed: TEYKLVVVGASGVGKSALTIQ (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKSALTIQ

SEQ ID NO: 27030 - protein, 22 aa, Artificial Sequence
  Description of Artificial Sequence: Synthetic peptide
  Seed: TEYKLVVVGASGVGKSALTIQL (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKSALTIQL

SEQ ID NO: 27031 - protein, 23 aa, Artificial Sequence
  Description of Artificial Sequence: Synthetic peptide
  Seed: TEYKLVVVGASGVGKSALTIQLI (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKSALTIQLI

SEQ ID NO: 27032 - protein, 24 aa, Artificial Sequence
  Description of Artificial Sequence: Synthetic peptide
  Seed: TEYKLVVVGASGVGKSALTIQLIQ (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKSALTIQLIQ

SEQ ID NO: 27033 - protein, 25 aa, Artificial Sequence
  Description of Artificial Sequence: Synthetic peptide
  Seed: TEYKLVVVGASGVGKSALTIQLIQN (KRAS G12S)
  Core: LVVVGASGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXSGXGKSALTIQLIQN

SEQ ID NO: 27034 - protein, 15 aa, Artificial Sequence
  Description of Artificial Sequence: Synthetic peptide
  Seed: VVVGASGVGKSALTI (KRAS G12S)
  Core: VVGASGVGK
  misc_feature (2)..(2): Xaa can be Ala, Cys, Asp, Glu, Phe, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Gly, His, Ile, Lys, Met, Asn, Pro, Gln, Arg, Ser, Thr, or Val
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXVGXSXVGXSALTI

SEQ ID NO: 27035 - protein, 13 aa, Artificial Sequence
  Description of Artificial Sequence: Synthetic peptide
  Seed: YKLVVVGASGVGK (KRAS G12S)
  Core: LVVVGASGV
  misc_feature (3)..(3): Xaa can be Ala, Cys, Phe, His, Ile, Leu, Met, Gln, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGK

SEQ ID NO: 27036 - protein, 14 aa, Artificial Sequence
  Description of Artificial Sequence: Synthetic peptide
  Seed: YKLVVVGASGVGKS (KRAS G12S)
  Core: LVVVGASGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKS

SEQ ID NO: 27037 - protein, 15 aa, Artificial Sequence
  Description of Artificial Sequence: Synthetic peptide
  Seed: YKLVVVGASGVGKSA (KRAS G12S)
  Core: LVVVGASGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSA

SEQ ID NO: 27038 - protein, 15 aa, Artificial Sequence
  Description of Artificial Sequence: Synthetic peptide
  Seed: YKLVVVGASGVGKSA (KRAS G12S)
  Core: VVGASGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXSXVGXSA

SEQ ID NO: 27039 - protein, 16 aa, Artificial Sequence
  Description of Artificial Sequence: Synthetic peptide
  Seed: YKLVVVGASGVGKSAL (KRAS G12S)
  Core: LVVVGASGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSAL

SEQ ID NO: 27040 - protein, 17 aa, Artificial Sequence
  Description of Artificial Sequence: Synthetic peptide
  Seed: YKLVVVGASGVGKSALT (KRAS G12S)
  Core: LVVVGASGV
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSALT

SEQ ID NO: 27041 - protein, 17 aa, Artificial Sequence
  Description of Artificial Sequence: Synthetic peptide
  Seed: YKLVVVGASGVGKSALT (KRAS G12S)
  Core: VVGASGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXSXVGXSALT

SEQ ID NO: 27042 - protein, 18 aa, Artificial Sequence
  Description of Artificial Sequence: Synthetic peptide
  Seed: YKLVVVGASGVGKSALTI (KRAS G12S)
  Core: LVVVGASGV
  misc_feature (3)..(3): Xaa can be Ala, Cys, Phe, His, Ile, Leu, Met, Asn, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSALTI

SEQ ID NO: 27043 - protein, 19 aa, Artificial Sequence
  Description of Artificial Sequence: Synthetic peptide
  Seed: YKLVVVGASGVGKSALTIQ (KRAS G12S)
  Core: LVVVGASGV
  misc_feature (3)..(3): Xaa can be Ala, Cys, Glu, Phe, His, Ile, Lys, Leu, Met, Asn, Pro, Gln, Arg, Ser, Thr, Val, Trp, or Ty r
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSALTIQ

SEQ ID NO: 27044 - protein, 19 aa, Artificial Sequence
  Description of Artificial Sequence: Synthetic peptide
  Seed: YKLVVVGASGVGKSALTIQ (KRAS G12S)
  Core: VVGASGVGK
  misc_feature (5)..(5): Xaa can be Ala, Cys, Asp, Phe, His, Ile, Leu, Met, Asn, Pro, Gln, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXSXVGXSALTIQ

SEQ ID NO: 27045 - protein, 20 aa, Artificial Sequence
  Description of Artificial Sequence: Synthetic peptide
  Seed: YKLVVVGASGVGKSALTIQL (KRAS G12S)
  Core: LVVVGASGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSALTIQL

SEQ ID NO: 27046 - protein, 20 aa, Artificial Sequence
  Description of Artificial Sequence: Synthetic peptide
  Seed: YKLVVVGASGVGKSALTIQL (KRAS G12S)
  Core: VVGASGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXSXVGXSALTIQL

SEQ ID NO: 27047 - protein, 21 aa, Artificial Sequence
  Description of Artificial Sequence: Synthetic peptide
  Seed: YKLVVVGASGVGKSALTIQLI (KRAS G12S)
  Core: LVVVGASGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSALTIQLI

SEQ ID NO: 27048 - protein, 21 aa, Artificial Sequence
  Description of Artificial Sequence: Synthetic peptide
  Seed: YKLVVVGASGVGKSALTIQLI (KRAS G12S)
  Core: VVGASGVGK
  misc_feature (5)..(5): Xaa can be Ala, Cys, Asp, Glu, Phe, His, Ile, Leu, Met, Asn, Pro, Gln, Arg, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXSXVGXSALTIQLI

SEQ ID NO: 27049 - protein, 22 aa, Artificial Sequence
  Description of Artificial Sequence: Synthetic peptide
  Seed: YKLVVVGASGVGKSALTIQLIQ (KRAS G12S)
  Core: LVVVGASGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSALTIQLIQ

SEQ ID NO: 27050 - protein, 22 aa, Artificial Sequence
  Description of Artificial Sequence: Synthetic peptide
  Seed: YKLVVVGASGVGKSALTIQLIQ (KRAS G12S)
  Core: VVGASGVGK
  misc_feature (5)..(5): Xaa can be Ala, Cys, Asp, Glu, Phe, His, Ile, Leu, Met, Asn, Pro, Gln, Arg, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXSXVGXSALTIQLIQ

SEQ ID NO: 27051 - protein, 23 aa, Artificial Sequence
  Description of Artificial Sequence: Synthetic peptide
  Seed: YKLVVVGASGVGKSALTIQLIQN (KRAS G12S)
  Core: LVVVGASGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSALTIQLIQN

SEQ ID NO: 27052 - protein, 23 aa, Artificial Sequence
  Description of Artificial Sequence: Synthetic peptide
  Seed: YKLVVVGASGVGKSALTIQLIQN (KRAS G12S)
  Core: VVGASGVGK
  misc_feature (5)..(5): Xaa can be Ala, Cys, Glu, Phe, His, Ile, Leu, Met, Asn, Pro, Gln, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXSXVGXSALTIQLIQN

SEQ ID NO: 27053 - protein, 24 aa, Artificial Sequence
  Description of Artificial Sequence: Synthetic peptide
  Seed: YKLVVVGASGVGKSALTIQLIQNH (KRAS G12S)
  Core: LVVVGASGV
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSALTIQLIQNH

SEQ ID NO: 27054 - protein, 24 aa, Artificial Sequence
  Description of Artificial Sequence: Synthetic peptide
  Seed: YKLVVVGASGVGKSALTIQLIQNH (KRAS G12S)
  Core: VVGASGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXSXVGXSALTIQLIQNH

SEQ ID NO: 27055 - protein, 25 aa, Artificial Sequence
  Description of Artificial Sequence: Synthetic peptide
  Seed: YKLVVVGASGVGKSALTIQLIQNHF (KRAS G12S)
  Core: LVVVGASGV
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXSGXGKSALTIQLIQNHF

SEQ ID NO: 27056 - protein, 25 aa, Artificial Sequence
  Description of Artificial Sequence: Synthetic peptide
  Seed: YKLVVVGASGVGKSALTIQLIQNHF (KRAS G12S)
  Core: VVGASGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXSXVGXSALTIQLIQNHF

SEQ ID NO: 27057 - protein, 13 aa, Artificial Sequence
  Description of Artificial Sequence: Synthetic peptide
  Seed: EYKLVVVGAVGVG (KRAS G12V)
  Core: LVVVGAVGV
  misc_feature (4)..(4): Xaa can be Ala, Cys, Phe, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXG

SEQ ID NO: 27058 - protein, 14 aa, Artificial Sequence
  Description of Artificial Sequence: Synthetic peptide
  Seed: EYKLVVVGAVGVGK (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGK

SEQ ID NO: 27059 - protein, 15 aa, Artificial Sequence
  Description of Artificial Sequence: Synthetic peptide
  Seed: EYKLVVVGAVGVGKS (KRAS G12V)
  Core: KLVVVGAVG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EYXLVXVXAVXVGKS

SEQ ID NO: 27060 - protein, 15 aa, Artificial Sequence
  Description of Artificial Sequence: Synthetic peptide
  Seed: EYKLVVVGAVGVGKS (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKS

SEQ ID NO: 27061 - protein, 16 aa, Artificial Sequence
  Description of Artificial Sequence: Synthetic peptide
  Seed: EYKLVVVGAVGVGKSA (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSA

SEQ ID NO: 27062 - protein, 17 aa, Artificial Sequence
  Description of Artificial Sequence: Synthetic peptide
  Seed: EYKLVVVGAVGVGKSAL (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSAL

SEQ ID NO: 27063 - protein, 18 aa, Artificial Sequence
  Description of Artificial Sequence: Synthetic peptide
  Seed: EYKLVVVGAVGVGKSALT (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSALT

SEQ ID NO: 27064 - protein, 19 aa, Artificial Sequence
  Description of Artificial Sequence: Synthetic peptide
  Seed: EYKLVVVGAVGVGKSALTI (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSALTI

SEQ ID NO: 27065 - protein, 20 aa, Artificial Sequence
  Description of Artificial Sequence: Synthetic peptide
  Seed: EYKLVVVGAVGVGKSALTIQ (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSALTIQ

SEQ ID NO: 27066 - protein, 21 aa, Artificial Sequence
  Description of Artificial Sequence: Synthetic peptide
  Seed: EYKLVVVGAVGVGKSALTIQL (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSALTIQL

SEQ ID NO: 27067 - protein, 22 aa, Artificial Sequence
  Description of Artificial Sequence: Synthetic peptide
  Seed: EYKLVVVGAVGVGKSALTIQLI (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSALTIQLI

SEQ ID NO: 27068 - protein, 23 aa, Artificial Sequence
  Description of Artificial Sequence: Synthetic peptide
  Seed: EYKLVVVGAVGVGKSALTIQLIQ (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSALTIQLIQ

SEQ ID NO: 27069 - protein, 24 aa, Artificial Sequence
  Description of Artificial Sequence: Synthetic peptide
  Seed: EYKLVVVGAVGVGKSALTIQLIQN (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSALTIQLIQN

SEQ ID NO: 27070 - protein, 25 aa, Artificial Sequence
  Description of Artificial Sequence: Synthetic peptide
  Seed: EYKLVVVGAVGVGKSALTIQLIQNH (KRAS G12V)
  Core: LVVVGAVGV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXVGXGKSALTIQLIQNH

SEQ ID NO: 27071 - protein, 13 aa, Artificial Sequence
  Description of Artificial Sequence: Synthetic peptide
  Seed: KLVVVGAVGVGKS (KRAS G12V)
  Core: LVVVGAVGV
  misc_feature (2)..(2): Xaa can be Cys, Phe, His, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXVGXGKS

SEQ ID NO: 27072 - protein, 14 aa, Artificial Sequence
  Description of Artificial Sequence: Synthetic peptide
  Seed: KLVVVGAVGVGKSA (KRAS G12V)
  Core: LVVVGAVGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXVGXGKSA

SEQ ID NO: 27073 - protein, 14 aa, Artificial Sequence
  Description of Artificial Sequence: Synthetic peptide
  Seed: KLVVVGAVGVGKSA (KRAS G12V)
  Core: VVGAVGVGK
  misc_feature (4)..(4): Xaa can be Ala, Cys, Glu, Phe, Gly, His, Ile, Leu, Met, Asn, Pro, Gln, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSA

SEQ ID NO: 27074 - protein, 15 aa, Artificial Sequence
  Description of Artificial Sequence: Synthetic peptide
  Seed: KLVVVGAVGVGKSAL (KRAS G12V)
  Core: LVVVGAVGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXVGXGKSAL

SEQ ID NO: 27075 - protein, 15 aa, Artificial Sequence
  Description of Artificial Sequence: Synthetic peptide
  Seed: KLVVVGAVGVGKSAL (KRAS G12V)
  Core: VVGAVGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSAL

SEQ ID NO: 27076 - protein, 16 aa, Artificial Sequence
  Description of Artificial Sequence: Synthetic peptide
  Seed: KLVVVGAVGVGKSALT (KRAS G12V)
  Core: LVVVGAVGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXVGXGKSALT

SEQ ID NO: 27077 - protein, 16 aa, Artificial Sequence
  Description of Artificial Sequence: Synthetic peptide
  Seed: KLVVVGAVGVGKSALT (KRAS G12V)
  Core: VVGAVGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSALT

SEQ ID NO: 27078 - protein, 17 aa, Artificial Sequence
  Description of Artificial Sequence: Synthetic peptide
  Seed: KLVVVGAVGVGKSALTI (KRAS G12V)
  Core: LVVVGAVGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXVGXGKSALTI

SEQ ID NO: 27079 - protein, 17 aa, Artificial Sequence
  Description of Artificial Sequence: Synthetic peptide
  Seed: KLVVVGAVGVGKSALTI (KRAS G12V)
  Core: VVGAVGVGK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSALTI

SEQ ID NO: 27080 - protein, 18 aa, Artificial Sequence
  Description of Artificial Sequence: Synthetic peptide
  Seed: KLVVVGAVGVGKSALTIQ (KRAS G12V)
  Core: LVVVGAVGV
  misc_feature (2)..(2): Xaa can be Ala, Cys, Phe, His, Ile, Leu, Met, Asn, Gln, Ser, Thr, Val, Trp, or Tyr
  misc_feature (5)..(5): Xaa can be Ala, Cys, Phe, His, Ile, Leu, Met, Asn, Gln, Ser, Thr, Val, Trp, or Tyr
  misc_feature (7)..(7): Xaa can be Ala, Asp, Glu, Phe, Gly, Ile, Leu, Met, Asn, Pro, Ser, Thr, Val, or Tyr
  misc_feature (10)..(10): Xaa can be Ala, Asp, Glu, Phe, Gly, His, Ile, Leu, Met, Asn, Pro, Gln, Ser, Thr, Val, or Tyr
KXVVXGXVGXGKSALTIQ

SEQ ID NO: 27081 - protein, 19 aa, Artificial Sequence
  Description of Artificial Sequence: Synthetic peptide
  Seed: KLVVVGAVGVGKSALTIQL (KRAS G12V)
  Core: LVVVGAVGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXVGXGKSALTIQL

SEQ ID NO: 27082 - protein, 19 aa, Artificial Sequence
  Description of Artificial Sequence: Synthetic peptide
  Seed: KLVVVGAVGVGKSALTIQL (KRAS G12V)
  Core: VVGAVGVGK
  misc_feature (4)..(4): Xaa can be Ala, Asp, Glu, Phe, His, Ile, Leu, Met, Gln, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSALTIQL

SEQ ID NO: 27083 - protein, 20 aa, Artificial Sequence
  Description of Artificial Sequence: Synthetic peptide
  Seed: KLVVVGAVGVGKSALTIQLI (KRAS G12V)
  Core: LVVVGAVGV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXVGXGKSALTIQLI

SEQ ID NO: 27084 - protein, 20 aa, Artificial Sequence
  Description of Artificial Sequence: Synthetic peptide
  Seed: KLVVVGAVGVGKSALTIQLI (KRAS G12V)
  Core: VVGAVGVGK
  misc_feature (4)..(4): Xaa can be Ala, Cys, Asp, Glu, Phe, His, Ile, Lys, Leu, Met, Asn, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSALTIQLI

SEQ ID NO: 27085 - protein, 21 aa, Artificial Sequence
  Description of Artificial Sequence: Synthetic peptide
  Seed: KLVVVGAVGVGKSALTIQLIQ (KRAS G12V)
  Core: LVVVGAVGV
  misc_feature (2)..(2): Xaa can be Ala, Cys, Asp, Glu, Phe, Gly, His, Ile, Lys, Leu, Met, Asn, Pro, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXVGXGKSALTIQLIQ

SEQ ID NO: 27086 - protein, 21 aa, Artificial Sequence
  Description of Artificial Sequence: Synthetic peptide
  Seed: KLVVVGAVGVGKSALTIQLIQ (KRAS G12V)
  Core: VVGAVGVGK
  misc_feature (4)..(4): Xaa can be Asp, Glu, Phe, His, Ile, Lys, Leu, Met, Asn, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSALTIQLIQ

SEQ ID NO: 27087 - protein, 22 aa, Artificial Sequence
  Description of Artificial Sequence: Synthetic peptide
  Seed: KLVVVGAVGVGKSALTIQLIQN (KRAS G12V)
  Core: LVVVGAVGV
  misc_feature (2)..(2): Xaa can be Ala, Cys, Asp, Glu, Phe, Gly, His, Ile, Lys, Leu, Met, Asn, Pro, Gln, Ser, Thr, Val, Trp, or Tyr
  misc_feature (5)..(5): Xaa can be Ala, Cys, Asp, Glu, Phe, His, Ile, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXVGXGKSALTIQLIQN

SEQ ID NO: 27088 - protein, 22 aa, Artificial Sequence
  Description of Artificial Sequence: Synthetic peptide
  Seed: KLVVVGAVGVGKSALTIQLIQN (KRAS G12V)
  Core: VVGAVGVGK
  misc_feature (4)..(4): Xaa can be Glu, Phe, Ile, Leu, Met, Asn, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSALTIQLIQN

SEQ ID NO: 27089 - protein, 23 aa, Artificial Sequence
  Description of Artificial Sequence: Synthetic peptide
  Seed: KLVVVGAVGVGKSALTIQLIQNH (KRAS G12V)
  Core: VVGAVGVGK
  misc_feature (4)..(4): Xaa can be Ala, Cys, Phe, Ile, Lys, Leu, Met, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSALTIQLIQNH

SEQ ID NO: 27090 - protein, 24 aa, Artificial Sequence
  Description of Artificial Sequence: Synthetic peptide
  Seed: KLVVVGAVGVGKSALTIQLIQNHF (KRAS G12V)
  Core: VVGAVGVGK
  misc_feature (4)..(4): Xaa can be Ala, Phe, Ile, Lys, Leu, Met, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KLVXVGXVXVGXSALTIQLIQNHF

SEQ ID NO: 27091 - protein, 24 aa, Artificial Sequence
  Description of Artificial Sequence: Synthetic peptide
  Seed: KLVVVGAVGVGKSALTIQLIQNHF (KRAS G12V)
  Core: AVGVGKSAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KLVVVGXVGXGXSAXTIQLIQNHF

SEQ ID NO: 27092 - protein, 25 aa, Artificial Sequence
  Description of Artificial Sequence: Synthetic peptide
  Seed: KLVVVGAVGVGKSALTIQLIQNHFV (KRAS G12V)
  Core: AVGVGKSAL
  misc_feature (7)..(7): Xaa can be Ala, Cys, Asp, Glu, Phe, Gly, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KLVVVGXVGXGXSAXTIQLIQNHFV

SEQ ID NO: 27093 - protein, 14 aa, Artificial Sequence
  Description of Artificial Sequence: Synthetic peptide
  Seed: LVVVGAVGVGKSAL (KRAS G12V)
  Core: VVGAVGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXVXVGXSAL

SEQ ID NO: 27094 - protein, 15 aa, Artificial Sequence
  Description of Artificial Sequence: Synthetic peptide
  Seed: LVVVGAVGVGKSALT (KRAS G12V)
  Core: VVGAVGVGK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LVXVGXVXVGXSALT

SEQ ID NO: 27095 - protein, 17 aa, Artificial Sequence
  Description of Artificial Sequence: Synthetic peptide
  Seed: LVVVGAVGVGKSALTIQ (KRAS G12V)
  Core: AVGVGKSAL
  misc_feature (6)..(6): Xaa can be Ala, Cys, Phe, Gly, His, Ile, Lys, Leu, Met, Asn, Pro, Gln, Arg, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LVVVGXVGXGXSAXTIQ

SEQ ID NO: 27096 - protein, 14 aa, Artificial Sequence
  Description of Artificial Sequence: Synthetic peptide
  Seed: MTEYKLVVVGAVGV (KRAS G12V)
  Core: LVVVGAVGV
  misc_feature (6)..(6): Xaa can be Phe, Ile, Leu, Met, Val, Trp, or Tyr
  misc_feature (9)..(9): Xaa can be Cys, Asp, Glu, Phe, His, Ile, Leu, Met, Asn, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, or Tyr
MTEYKXVVXGXVGX

SEQ ID NO: 27097 - protein, 15 aa, Artificial Sequence
  Description of Artificial Sequence: Synthetic peptide
  Seed: MTEYKLVVVGAVGVG (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXG

SEQ ID NO: 27098 - protein, 16 aa, Artificial Sequence
  Description of Artificial Sequence: Synthetic peptide
  Seed: MTEYKLVVVGAVGVGK (KRAS G12V)
  Core: KLVVVGAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXAVXVGK

SEQ ID NO: 27099 - protein, 16 aa, Artificial Sequence
  Description of Artificial Sequence: Synthetic peptide
  Seed: MTEYKLVVVGAVGVGK (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGK

SEQ ID NO: 27100 - protein, 17 aa, Artificial Sequence
  Description of Artificial Sequence: Synthetic peptide
  Seed: MTEYKLVVVGAVGVGKS (KRAS G12V)
  Core: KLVVVGAVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEYXLVXVXAVXVGKS

SEQ ID NO: 27101 - protein, 17 aa, Artificial Sequence
  Description of Artificial Sequence: Synthetic peptide
  Seed: MTEYKLVVVGAVGVGKS (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGKS

SEQ ID NO: 27102 - protein, 18 aa, Artificial Sequence
  Description of Artificial Sequence: Synthetic peptide
  Seed: MTEYKLVVVGAVGVGKSA (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGKSA

SEQ ID NO: 27103 - protein, 19 aa, Artificial Sequence
  Description of Artificial Sequence: Synthetic peptide
  Seed: MTEYKLVVVGAVGVGKSAL (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGKSAL

SEQ ID NO: 27104 - protein, 20 aa, Artificial Sequence
  Description of Artificial Sequence: Synthetic peptide
  Seed: MTEYKLVVVGAVGVGKSALT (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGKSALT

SEQ ID NO: 27105 - protein, 21 aa, Artificial Sequence
  Description of Artificial Sequence: Synthetic peptide
  Seed: MTEYKLVVVGAVGVGKSALTI (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGKSALTI

SEQ ID NO: 27106 - protein, 22 aa, Artificial Sequence
  Description of Artificial Sequence: Synthetic peptide
  Seed: MTEYKLVVVGAVGVGKSALTIQ (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGKSALTIQ

SEQ ID NO: 27107 - protein, 23 aa, Artificial Sequence
  Description of Artificial Sequence: Synthetic peptide
  Seed: MTEYKLVVVGAVGVGKSALTIQL (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGKSALTIQL

SEQ ID NO: 27108 - protein, 24 aa, Artificial Sequence
  Description of Artificial Sequence: Synthetic peptide
  Seed: MTEYKLVVVGAVGVGKSALTIQLI (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGKSALTIQLI

SEQ ID NO: 27109 - protein, 25 aa, Artificial Sequence
  Description of Artificial Sequence: Synthetic peptide
  Seed: MTEYKLVVVGAVGVGKSALTIQLIQ (KRAS G12V)
  Core: LVVVGAVGV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXVGXGKSALTIQLIQ

SEQ ID NO: 27110 - protein, 13 aa, Artificial Sequence
  Description of Artificial Sequence: Synthetic peptide
  Seed: TEYKLVVVGAVGV (KRAS G12V)
  Core: LVVVGAVGV
  misc_feature (5)..(5): Xaa can be Phe, Ile, Leu, Met, Val, Trp, or Tyr
  misc_feature (8)..(8): Xaa can be Ala, Cys, Asp, Glu, His, Ile, Leu, Met, Asn, Gln, Ser, Thr, or Val
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, or Ty r
TEYKXVVXGXVGX

SEQ ID NO: 27111 - protein, 14 aa, Artificial Sequence
  Description of Artificial Sequence: Synthetic peptide
  Seed: TEYKLVVVGAVGVG (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXG

SEQ ID NO: 27112 - protein, 15 aa, Artificial Sequence
  Description of Artificial Sequence: Synthetic peptide
  Seed: TEYKLVVVGAVGVGK (KRAS G12V)
  Core: KLVVVGAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXAVXVGK

SEQ ID NO: 27113 - protein, 15 aa, Artificial Sequence
  Description of Artificial Sequence: Synthetic peptide
  Seed: TEYKLVVVGAVGVGK (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGK

SEQ ID NO: 27114 - protein, 16 aa, Artificial Sequence
  Description of Artificial Sequence: Synthetic peptide
  Seed: TEYKLVVVGAVGVGKS (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKS

SEQ ID NO: 27115 - protein, 17 aa, Artificial Sequence
  Description of Artificial Sequence: Synthetic peptide
  Seed: TEYKLVVVGAVGVGKSA (KRAS G12V)
  Core: KLVVVGAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEYXLVXVXAVXVGKSA

SEQ ID NO: 27116 - protein, 17 aa, Artificial Sequence
  Description of Artificial Sequence: Synthetic peptide
  Seed: TEYKLVVVGAVGVGKSA (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKSA

SEQ ID NO: 27117 - protein, 18 aa, Artificial Sequence
  Description of Artificial Sequence: Synthetic peptide
  Seed: TEYKLVVVGAVGVGKSAL (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKSAL

SEQ ID NO: 27118 - protein, 19 aa, Artificial Sequence
  Description of Artificial Sequence: Synthetic peptide
  Seed: TEYKLVVVGAVGVGKSALT (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKSALT

SEQ ID NO: 27119 - protein, 20 aa, Artificial Sequence
  Description of Artificial Sequence: Synthetic peptide
  Seed: TEYKLVVVGAVGVGKSALTI (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKSALTI

SEQ ID NO: 27120 - protein, 21 aa, Artificial Sequence
  Description of Artificial Sequence: Synthetic peptide
  Seed: TEYKLVVVGAVGVGKSALTIQ (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKSALTIQ

SEQ ID NO: 27121 - protein, 22 aa, Artificial Sequence
  Description of Artificial Sequence: Synthetic peptide
  Seed: TEYKLVVVGAVGVGKSALTIQL (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKSALTIQL

SEQ ID NO: 27122 - protein, 23 aa, Artificial Sequence
  Description of Artificial Sequence: Synthetic peptide
  Seed: TEYKLVVVGAVGVGKSALTIQLI (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKSALTIQLI

SEQ ID NO: 27123 - protein, 24 aa, Artificial Sequence
  Description of Artificial Sequence: Synthetic peptide
  Seed: TEYKLVVVGAVGVGKSALTIQLIQ (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKSALTIQLIQ

SEQ ID NO: 27124 - protein, 25 aa, Artificial Sequence
  Description of Artificial Sequence: Synthetic peptide
  Seed: TEYKLVVVGAVGVGKSALTIQLIQN (KRAS G12V)
  Core: LVVVGAVGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXVGXGKSALTIQLIQN

SEQ ID NO: 27125 - protein, 15 aa, Artificial Sequence
  Description of Artificial Sequence: Synthetic peptide
  Seed: VVVGAVGVGKSALTI (KRAS G12V)
  Core: AVGVGKSAL
  misc_feature (5)..(5): Xaa can be Ala, Cys, Phe, Gly, His, Ile, Lys, Leu, Met, Asn, Pro, Gln, Arg, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVVGXVGXGXSAXTI

SEQ ID NO: 27126 - protein, 13 aa, Artificial Sequence
  Description of Artificial Sequence: Synthetic peptide
  Seed: YKLVVVGAVGVGK (KRAS G12V)
  Core: LVVVGAVGV
  misc_feature (3)..(3): Xaa can be Ala, Cys, Glu, Phe, Gly, His, Ile, Lys, Leu, Met, Asn, Gln, Arg, Ser, Thr, Val, Trp, or Ty r
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGK

SEQ ID NO: 27127 - protein, 14 aa, Artificial Sequence
  Description of Artificial Sequence: Synthetic peptide
  Seed: YKLVVVGAVGVGKS (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKS

SEQ ID NO: 27128 - protein, 15 aa, Artificial Sequence
  Description of Artificial Sequence: Synthetic peptide
  Seed: YKLVVVGAVGVGKSA (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSA

SEQ ID NO: 27129 - protein, 15 aa, Artificial Sequence
  Description of Artificial Sequence: Synthetic peptide
  Seed: YKLVVVGAVGVGKSA (KRAS G12V)
  Core: VVGAVGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXVXVGXSA

SEQ ID NO: 27130 - protein, 16 aa, Artificial Sequence
  Description of Artificial Sequence: Synthetic peptide
  Seed: YKLVVVGAVGVGKSAL (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSAL

SEQ ID NO: 27131 - protein, 16 aa, Artificial Sequence
  Description of Artificial Sequence: Synthetic peptide
  Seed: YKLVVVGAVGVGKSAL (KRAS G12V)
  Core: VVGAVGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXVXVGXSAL

SEQ ID NO: 27132 - protein, 17 aa, Artificial Sequence
  Description of Artificial Sequence: Synthetic peptide
  Seed: YKLVVVGAVGVGKSALT (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSALT

SEQ ID NO: 27133 - protein, 17 aa, Artificial Sequence
  Description of Artificial Sequence: Synthetic peptide
  Seed: YKLVVVGAVGVGKSALT (KRAS G12V)
  Core: VVGAVGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXVXVGXSALT

SEQ ID NO: 27134 - protein, 18 aa, Artificial Sequence
  Description of Artificial Sequence: Synthetic peptide
  Seed: YKLVVVGAVGVGKSALTI (KRAS G12V)
  Core: LVVVGAVGV
  misc_feature (3)..(3): Xaa can be Ala, Cys, Glu, Phe, His, Ile, Lys, Leu, Met, Asn, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSALTI

SEQ ID NO: 27135 - protein, 19 aa, Artificial Sequence
  Description of Artificial Sequence: Synthetic peptide
  Seed: YKLVVVGAVGVGKSALTIQ (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSALTIQ

SEQ ID NO: 27136 - protein, 20 aa, Artificial Sequence
  Description of Artificial Sequence: Synthetic peptide
  Seed: YKLVVVGAVGVGKSALTIQL (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSALTIQL

SEQ ID NO: 27137 - protein, 20 aa, Artificial Sequence
  Description of Artificial Sequence: Synthetic peptide
  Seed: YKLVVVGAVGVGKSALTIQL (KRAS G12V)
  Core: VVGAVGVGK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXVXVGXSALTIQL

SEQ ID NO: 27138 - protein, 21 aa, Artificial Sequence
  Description of Artificial Sequence: Synthetic peptide
  Seed: YKLVVVGAVGVGKSALTIQLI (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSALTIQLI

SEQ ID NO: 27139 - protein, 21 aa, Artificial Sequence
  Description of Artificial Sequence: Synthetic peptide
  Seed: YKLVVVGAVGVGKSALTIQLI (KRAS G12V)
  Core: VVGAVGVGK
  misc_feature (5)..(5): Xaa can be Asp, Glu, Phe, His, Ile, Lys, Leu, Met, Asn, Gln, Arg, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXVXVGXSALTIQLI

SEQ ID NO: 27140 - protein, 22 aa, Artificial Sequence
  Description of Artificial Sequence: Synthetic peptide
  Seed: YKLVVVGAVGVGKSALTIQLIQ (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSALTIQLIQ

SEQ ID NO: 27141 - protein, 22 aa, Artificial Sequence
  Description of Artificial Sequence: Synthetic peptide
  Seed: YKLVVVGAVGVGKSALTIQLIQ (KRAS G12V)
  Core: VVGAVGVGK
  misc_feature (5)..(5): Xaa can be Ala, Asp, Glu, Phe, His, Ile, Lys, Leu, Met, Asn, Gln, Arg, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXVXVGXSALTIQLIQ

SEQ ID NO: 27142 - protein, 23 aa, Artificial Sequence
  Description of Artificial Sequence: Synthetic peptide
  Seed: YKLVVVGAVGVGKSALTIQLIQN (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSALTIQLIQN

SEQ ID NO: 27143 - protein, 23 aa, Artificial Sequence
  Description of Artificial Sequence: Synthetic peptide
  Seed: YKLVVVGAVGVGKSALTIQLIQN (KRAS G12V)
  Core: VVGAVGVGK
  misc_feature (5)..(5): Xaa can be Ala, Asp, Glu, Phe, Gly, His, Ile, Leu, Met, Asn, Gln, Arg, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXVXVGXSALTIQLIQN

SEQ ID NO: 27144 - protein, 24 aa, Artificial Sequence
  Description of Artificial Sequence: Synthetic peptide
  Seed: YKLVVVGAVGVGKSALTIQLIQNH (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSALTIQLIQNH

SEQ ID NO: 27145 - protein, 24 aa, Artificial Sequence
  Description of Artificial Sequence: Synthetic peptide
  Seed: YKLVVVGAVGVGKSALTIQLIQNH (KRAS G12V)
  Core: VVGAVGVGK
  misc_feature (5)..(5): Xaa can be Ala, Cys, Phe, Gly, His, Ile, Lys, Leu, Met, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXVXVGXSALTIQLIQNH

SEQ ID NO: 27146 - protein, 25 aa, Artificial Sequence
  Description of Artificial Sequence: Synthetic peptide
  Seed: YKLVVVGAVGVGKSALTIQLIQNHF (KRAS G12V)
  Core: LVVVGAVGV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXVGXGKSALTIQLIQNHF

SEQ ID NO: 27147 - protein, 25 aa, Artificial Sequence
  Description of Artificial Sequence: Synthetic peptide
  Seed: YKLVVVGAVGVGKSALTIQLIQNHF (KRAS G12V)
  Core: VVGAVGVGK
  misc_feature (5)..(5): Xaa can be Phe, His, Ile, Lys, Leu, Met, Arg, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKLVXVGXVXVGXSALTIQLIQNHF

SEQ ID NO: 27148 - protein, 25 aa, Artificial Sequence
  Description of Artificial Sequence: Synthetic peptide
  Seed: YKLVVVGAVGVGKSALTIQLIQNHF (KRAS G12V)
  Core: AVGVGKSAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKLVVVGXVGXGXSAXTIQLIQNHF

SEQ ID NO: 27149 - protein, 13 aa, Artificial Sequence
  Description of Artificial Sequence: Synthetic peptide
  Seed: EYKLVVVGAGDVG (KRAS G13D)
  Core: LVVVGAGDV
  misc_feature (4)..(4): Xaa can be Phe, Ile, Leu, Met, Val, Trp, or Tyr
  misc_feature (7)..(7): Xaa can be Ala, Cys, Glu, Phe, Gly, His, Ile, Leu, Met, Asn, Gln, Ser, Thr, Val, or Trp
  misc_feature (9)..(9): Xaa can be Ala, Cys, Asp, Glu, Gly, His, Ile, Leu, Met, Asn, Pro, Gln, Ser, Thr, Val, or Trp
  misc_feature (12)..(12): Xaa can be Ala, Cys, Phe, Gly, His, Ile, Lys, Leu, Met, Asn, Pro, Gln, Arg, Ser, Thr, Val, or Tyr
EYKXVVXGXGDXG

SEQ ID NO: 27150 - protein, 14 aa, Artificial Sequence
  Description of Artificial Sequence: Synthetic peptide
  Seed: EYKLVVVGAGDVGK (KRAS G13D)
  Core: LVVVGAGDV
  misc_feature (4)..(4): Xaa can be Ala, Cys, Glu, Phe, His, Ile, Leu, Met, Asn, Pro, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGK

SEQ ID NO: 27151 - protein, 15 aa, Artificial Sequence
  Description of Artificial Sequence: Synthetic peptide
  Seed: EYKLVVVGAGDVGKS (KRAS G13D)
  Core: LVVVGAGDV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKS

SEQ ID NO: 27152 - protein, 15 aa, Artificial Sequence
  Description of Artificial Sequence: Synthetic peptide
  Seed: EYKLVVVGAGDVGKS (KRAS G13D)
  Core: VVVGAGDVG
  misc_feature (5)..(5): Xaa can be Ala, Cys, Asp, Glu, Phe, Gly, His, Ile, Leu, Met, Asn, Pro, Gln, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EYKLXVVXAXDVXKS

SEQ ID NO: 27153 - protein, 15 aa, Artificial Sequence
  Description of Artificial Sequence: Synthetic peptide
  Seed: EYKLVVVGAGDVGKS (KRAS G13D)
  Core: VGAGDVGKS
  misc_feature (7)..(7): Xaa can be Ala, Cys, Glu, Phe, His, Ile, Leu, Met, Asn, Pro, Gln, Thr, Val, Trp, or Tyr
  misc_feature (10)..(10): Xaa can be Ala, Gly, Ser, Thr, Val, or Trp
  misc_feature (12)..(12): Xaa can be Ala, Cys, Glu, Gly, Ile, Leu, Met, Pro, Ser, Thr, or Val
  misc_feature (15)..(15): Xaa can be Ala, Cys, Asp, Glu, Phe, Gly, His, Ile, Leu, Met, Asn, Pro, Gln, Ser, Thr, Val, Trp, or Ty r
EYKLVVXGAXDXGKX

SEQ ID NO: 27154 - protein, 16 aa, Artificial Sequence
  Description of Artificial Sequence: Synthetic peptide
  Seed: EYKLVVVGAGDVGKSA (KRAS G13D)
  Core: LVVVGAGDV
  misc_feature (4)..(4): Xaa can be Ala, Cys, Phe, His, Ile, Lys, Leu, Met, Asn, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSA

SEQ ID NO: 27155 - protein, 16 aa, Artificial Sequence
  Description of Artificial Sequence: Synthetic peptide
  Seed: EYKLVVVGAGDVGKSA (KRAS G13D)
  Core: VVVGAGDVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EYKLXVVXAXDVXKSA

SEQ ID NO: 27156 - protein, 16 aa, Artificial Sequence
  Description of Artificial Sequence: Synthetic peptide
  Seed: EYKLVVVGAGDVGKSA (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Asp, Glu, Phe, Gly, Ile, Met, Asn, Ser, Thr, Val, or Trp
  misc_feature (12)..(12): Xaa can be Ala, Cys, Asp, Glu, Phe, Gly, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Ser, Thr, Val, Trp, or Ty r
EYKLVVXGAXDXGKXA

SEQ ID NO: 27157 - protein, 17 aa, Artificial Sequence
  Description of Artificial Sequence: Synthetic peptide
  Seed: EYKLVVVGAGDVGKSAL (KRAS G13D)
  Core: LVVVGAGDV
  misc_feature (4)..(4): Xaa can be Ala, Cys, Phe, His, Ile, Leu, Met, Asn, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSAL

SEQ ID NO: 27158 - protein, 17 aa, Artificial Sequence
  Description of Artificial Sequence: Synthetic peptide
  Seed: EYKLVVVGAGDVGKSAL (KRAS G13D)
  Core: VVVGAGDVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EYKLXVVXAXDVXKSAL

SEQ ID NO: 27159 - protein, 17 aa, Artificial Sequence
  Description of Artificial Sequence: Synthetic peptide
  Seed: EYKLVVVGAGDVGKSAL (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Phe, Gly, Ile, Leu, Met, Asn, Ser, Thr, Val, or Trp
  misc_feature (12)..(12): Xaa can be Ala, Cys, Asp, Glu, Phe, Gly, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Ser, Thr, Val, Trp, or Ty r
EYKLVVXGAXDXGKXAL

SEQ ID NO: 27160 - protein, 18 aa, Artificial Sequence
  Description of Artificial Sequence: Synthetic peptide
  Seed: EYKLVVVGAGDVGKSALT (KRAS G13D)
  Core: LVVVGAGDV
  misc_feature (4)..(4): Xaa can be Cys, Phe, Ile, Leu, Met, Asn, Val, Trp, or Tyr
  misc_feature (7)..(7): Xaa can be Ala, Cys, Asp, Glu, Phe, Gly, His, Ile, Leu, Met, Asn, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSALT

SEQ ID NO: 27161 - protein, 18 aa, Artificial Sequence
  Description of Artificial Sequence: Synthetic peptide
  Seed: EYKLVVVGAGDVGKSALT (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Phe, Gly, His, Ile, Leu, Met, Asn, Gln, Ser, Thr, Val, or Trp
  misc_feature (12)..(12): Xaa can be Ala, Cys, Asp, Phe, Gly, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Ser, Thr, Val, Trp, or Ty r
EYKLVVXGAXDXGKXALT

SEQ ID NO: 27162 - protein, 19 aa, Artificial Sequence
  Description of Artificial Sequence: Synthetic peptide
  Seed: EYKLVVVGAGDVGKSALTI (KRAS G13D)
  Core: LVVVGAGDV
  misc_feature (4)..(4): Xaa can be Ala, Cys, Glu, Phe, His, Ile, Leu, Met, Asn, Gln, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSALTI

SEQ ID NO: 27163 - protein, 19 aa, Artificial Sequence
  Description of Artificial Sequence: Synthetic peptide
  Seed: EYKLVVVGAGDVGKSALTI (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Asp, Phe, Gly, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
EYKLVVXGAXDXGKXALTI

SEQ ID NO: 27164 - protein, 20 aa, Artificial Sequence
  Description of Artificial Sequence: Synthetic peptide
  Seed: EYKLVVVGAGDVGKSALTIQ (KRAS G13D)
  Core: LVVVGAGDV
  misc_feature (4)..(4): Xaa can be Ala, Cys, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSALTIQ

SEQ ID NO: 27165 - protein, 20 aa, Artificial Sequence
  Description of Artificial Sequence: Synthetic peptide
  Seed: EYKLVVVGAGDVGKSALTIQ (KRAS G13D)
  Core: VVVGAGDVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EYKLXVVXAXDVXKSALTIQ

SEQ ID NO: 27166 - protein, 20 aa, Artificial Sequence
  Description of Artificial Sequence: Synthetic peptide
  Seed: EYKLVVVGAGDVGKSALTIQ (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
EYKLVVXGAXDXGKXALTIQ

SEQ ID NO: 27167 - protein, 21 aa, Artificial Sequence
  Description of Artificial Sequence: Synthetic peptide
  Seed: EYKLVVVGAGDVGKSALTIQL (KRAS G13D)
  Core: LVVVGAGDV
  misc_feature (4)..(4): Xaa can be Ala, Cys, Phe, His, Ile, Lys, Leu, Met, Asn, Pro, Gln, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSALTIQL

SEQ ID NO: 27168 - protein, 21 aa, Artificial Sequence
  Description of Artificial Sequence: Synthetic peptide
  Seed: EYKLVVVGAGDVGKSALTIQL (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Phe, Gly, His, Ile, Leu, Met, Asn, Pro, Ser, Thr, Val, or Trp
  misc_feature (12)..(12): Xaa can be Ala, Cys, Asp, Glu, Gly, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
EYKLVVXGAXDXGKXALTIQL

SEQ ID NO: 27169 - protein, 22 aa, Artificial Sequence
  Description of Artificial Sequence: Synthetic peptide
  Seed: EYKLVVVGAGDVGKSALTIQLI (KRAS G13D)
  Core: LVVVGAGDV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSALTIQLI

SEQ ID NO: 27170 - protein, 22 aa, Artificial Sequence
  Description of Artificial Sequence: Synthetic peptide
  Seed: EYKLVVVGAGDVGKSALTIQLI (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Phe, Gly, His, Ile, Leu, Met, Asn, Pro, Ser, Thr, Val, or Trp
  misc_feature (12)..(12): Xaa can be Ala, Cys, Asp, Glu, Phe, Gly, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
EYKLVVXGAXDXGKXALTIQLI

SEQ ID NO: 27171 - protein, 23 aa, Artificial Sequence
  Description of Artificial Sequence: Synthetic peptide
  Seed: EYKLVVVGAGDVGKSALTIQLIQ (KRAS G13D)
  Core: LVVVGAGDV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSALTIQLIQ

SEQ ID NO: 27172 - protein, 23 aa, Artificial Sequence
  Description of Artificial Sequence: Synthetic peptide
  Seed: EYKLVVVGAGDVGKSALTIQLIQ (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Phe, Gly, His, Ile, Leu, Met, Asn, Pro, Ser, Thr, Val, Trp, or Tyr
  misc_feature (12)..(12): Xaa can be Ala, Cys, Asp, Glu, Phe, Gly, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
EYKLVVXGAXDXGKXALTIQLIQ

SEQ ID NO: 27173 - protein, 24 aa, Artificial Sequence
  Description of Artificial Sequence: Synthetic peptide
  Seed: EYKLVVVGAGDVGKSALTIQLIQN (KRAS G13D)
  Core: LVVVGAGDV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSALTIQLIQN

SEQ ID NO: 27174 - protein, 24 aa, Artificial Sequence
  Description of Artificial Sequence: Synthetic peptide
  Seed: EYKLVVVGAGDVGKSALTIQLIQN (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Asp, Phe, Gly, His, Ile, Leu, Met, Asn, Ser, Thr, Val, Trp, or Tyr
  misc_feature (12)..(12): Xaa can be Ala, Cys, Asp, Glu, Phe, Gly, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
EYKLVVXGAXDXGKXALTIQLIQN

SEQ ID NO: 27175 - protein, 25 aa, Artificial Sequence
  Description of Artificial Sequence: Synthetic peptide
  Seed: EYKLVVVGAGDVGKSALTIQLIQNH (KRAS G13D)
  Core: LVVVGAGDV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYKXVVXGXGDXGKSALTIQLIQNH

SEQ ID NO: 27176 - protein, 25 aa, Artificial Sequence
  Description of Artificial Sequence: Synthetic peptide
  Seed: EYKLVVVGAGDVGKSALTIQLIQNH (KRAS G13D)
  Core: VVVGAGDVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EYKLXVVXAXDVXKSALTIQLIQNH

SEQ ID NO: 27177 - protein, 25 aa, Artificial Sequence
  Description of Artificial Sequence: Synthetic peptide
  Seed: EYKLVVVGAGDVGKSALTIQLIQNH (KRAS G13D)
  Core: VGAGDVGKS
  misc_feature (7)..(7): Xaa can be Ala, Cys, Asp, Glu, Phe, His, Ile, Lys, Leu, Met, Asn, Pro, Gln, Ser, Thr, Val, Trp, or Ty r
  misc_feature (10)..(10): Xaa can be Ala, Cys, Asp, Phe, Gly, His, Ile, Leu, Met, Asn, Ser, Thr, Val, or Trp
  misc_feature (12)..(12): Xaa can be Ala, Cys, Asp, Glu, Phe, Gly, Ile, Leu, Met, Asn, Pro, Ser, Thr, or Val
  misc_feature (15)..(15): Xaa can be Ala, Cys, Asp, Glu, Phe, Gly, His, Ile, Leu, Met, Asn, Pro, Gln, Arg, Ser, Thr, Val, Trp, or Tyr
EYKLVVXGAXDXGKXALTIQLIQNH

SEQ ID NO: 27178 - protein, 13 aa, Artificial Sequence
  Description of Artificial Sequence: Synthetic peptide
  Seed: KLVVVGAGDVGKS (KRAS G13D)
  Core: VGAGDVGKS
  misc_feature (5)..(5): Xaa can be Ala, Phe, Ile, Leu, Met, Asn, Pro, Thr, Val, Trp, or Tyr
  misc_feature (8)..(8): Xaa can be Ala, Gly, Ile, Ser, Thr, or Val
  misc_feature (10)..(10): Xaa can be Ala, Cys, Ile, Leu, Met, Pro, Ser, Thr, or Val
  misc_feature (13)..(13): Xaa can be Ala, Cys, Asp, Glu, Phe, Gly, His, Ile, Leu, Met, Asn, Pro, Gln, Ser, Thr, Val, Trp, or Ty r
KLVVXGAXDXGKX

SEQ ID NO: 27179 - protein, 14 aa, Artificial Sequence
  Description of Artificial Sequence: Synthetic peptide
  Seed: KLVVVGAGDVGKSA (KRAS G13D)
  Core: LVVVGAGDV
  misc_feature (2)..(2): Xaa can be Cys, Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Ser, Thr, Val, Trp, or Ty r
  misc_feature (7)..(7): Xaa can be Ala, Cys, Asp, Glu, Gly, His, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXGDXGKSA

SEQ ID NO: 27180 - protein, 14 aa, Artificial Sequence
  Description of Artificial Sequence: Synthetic peptide
  Seed: KLVVVGAGDVGKSA (KRAS G13D)
  Core: VGAGDVGKS
  misc_feature (5)..(5): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Cys, Phe, Gly, His, Ile, Leu, Met, Asn, Gln, Ser, Thr, Val, or Trp
  misc_feature (10)..(10): Xaa can be Ala, Cys, Glu, Phe, Gly, Ile, Leu, Met, Asn, Pro, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KLVVXGAXDXGKXA

SEQ ID NO: 27181 - protein, 15 aa, Artificial Sequence
  Description of Artificial Sequence: Synthetic peptide
  Seed: KLVVVGAGDVGKSAL (KRAS G13D)
  Core: LVVVGAGDV
  misc_feature (2)..(2): Xaa can be Cys, Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXGDXGKSAL

SEQ ID NO: 27182 - protein, 15 aa, Artificial Sequence
  Description of Artificial Sequence: Synthetic peptide
  Seed: KLVVVGAGDVGKSAL (KRAS G13D)
  Core: VVVGAGDVG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KLXVVXAXDVXKSAL

SEQ ID NO: 27183 - protein, 15 aa, Artificial Sequence
  Description of Artificial Sequence: Synthetic peptide
  Seed: KLVVVGAGDVGKSAL (KRAS G13D)
  Core: VGAGDVGKS
  misc_feature (5)..(5): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Leu, Met, Asn, Pro, Gln, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KLVVXGAXDXGKXAL

SEQ ID NO: 27184 - protein, 16 aa, Artificial Sequence
  Description of Artificial Sequence: Synthetic peptide
  Seed: KLVVVGAGDVGKSALT (KRAS G13D)
  Core: VVVGAGDVG
  misc_feature (3)..(3): Xaa can be Ala, Cys, Asp, Glu, Phe, Gly, His, Ile, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KLXVVXAXDVXKSALT

SEQ ID NO: 27185 - protein, 16 aa, Artificial Sequence
  Description of Artificial Sequence: Synthetic peptide
  Seed: KLVVVGAGDVGKSALT (KRAS G13D)
  Core: VGAGDVGKS
  misc_feature (5)..(5): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KLVVXGAXDXGKXALT

SEQ ID NO: 27186 - protein, 17 aa, Artificial Sequence
  Description of Artificial Sequence: Synthetic peptide
  Seed: KLVVVGAGDVGKSALTI (KRAS G13D)
  Core: LVVVGAGDV
  misc_feature (2)..(2): Xaa can be Cys, Phe, Ile, Leu, Met, Val, Trp, or Tyr
  misc_feature (5)..(5): Xaa can be Ala, Cys, Phe, His, Ile, Leu, Met, Asn, Gln, Ser, Thr, Val, Trp, or Tyr
  misc_feature (7)..(7): Xaa can be Ala, Asp, Gly, Ile, Leu, Met, Asn, Pro, Ser, Thr, or Val
  misc_feature (10)..(10): Xaa can be Ala, Cys, Asp, Glu, Phe, Gly, Ile, Leu, Met, Asn, Gln, Ser, Thr, Val, Trp, or Tyr
KXVVXGXGDXGKSALTI

SEQ ID NO: 27187 - protein, 17 aa, Artificial Sequence
  Description of Artificial Sequence: Synthetic peptide
  Seed: KLVVVGAGDVGKSALTI (KRAS G13D)
  Core: VVVGAGDVG
  misc_feature (3)..(3): Xaa can be Ala, Cys, Asp, Glu, Phe, Gly, His, Ile, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KLXVVXAXDVXKSALTI

SEQ ID NO: 27188 - protein, 17 aa, Artificial Sequence
  Description of Artificial Sequence: Synthetic peptide
  Seed: KLVVVGAGDVGKSALTI (KRAS G13D)
  Core: VGAGDVGKS
  misc_feature (5)..(5): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Leu, Met, Asn, Pro, Gln, Ser, Thr, Val, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KLVVXGAXDXGKXALTI

SEQ ID NO: 27189 - protein, 18 aa, Artificial Sequence
  Description of Artificial Sequence: Synthetic peptide
  Seed: KLVVVGAGDVGKSALTIQ (KRAS G13D)
  Core: VGAGDVGKS
  misc_feature (5)..(5): Xaa can be Ala, Cys, Asp, Glu, Phe, His, Ile, Leu, Met, Asn, Pro, Gln, Ser, Thr, Val, Trp, or Tyr
  misc_feature (8)..(8): Xaa can be Ala, Cys, Gly, Ile, Met, Asn, Ser, Thr, or Val
  misc_feature (10)..(10): Xaa can be Ala, Cys, Gly, Ile, Leu, Met, Asn, Pro, Ser, Thr, or Val
  misc_feature (13)..(13): Xaa can be Ala, Cys, Asp, Glu, Phe, Gly, His, Ile, Leu, Met, Asn, Pro, Gln, Ser, Thr, Val, Trp, or Ty r
KLVVXGAXDXGKXALTIQ

SEQ ID NO: 27190 - protein, 19 aa, Artificial Sequence
  Description of Artificial Sequence: Synthetic peptide
  Seed: KLVVVGAGDVGKSALTIQL (KRAS G13D)
  Core: LVVVGAGDV
  misc_feature (2)..(2): Xaa can be Ala, Cys, Phe, Ile, Leu, Met, Val, Trp, or Tyr
  misc_feature (5)..(5): Xaa can be Ala, Cys, Asp, Glu, Phe, Gly, His, Ile, Lys, Leu, Met, Asn, Gln, Ser, Thr, Val, Trp, or Ty r
  misc_feature (7)..(7): Xaa can be Ala, Cys, Asp, Glu, Phe, Gly, His, Ile, Leu, Met, Asn, Pro, Gln, Arg, Ser, Thr, Val, or Tr p
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXGDXGKSALTIQL

SEQ ID NO: 27191 - protein, 19 aa, Artificial Sequence
  Description of Artificial Sequence: Synthetic peptide
  Seed: KLVVVGAGDVGKSALTIQL (KRAS G13D)
  Core: VGAGDVGKS
  misc_feature (5)..(5): Xaa can be Ala, Cys, Asp, Glu, Phe, His, Ile, Lys, Leu, Met, Asn, Pro, Gln, Ser, Thr, Val, Trp, or Ty r
  misc_feature (8)..(8): Xaa can be Ala, Cys, Asp, Phe, Gly, His, Ile, Leu, Met, Asn, Pro, Gln, Ser, Thr, Val, or Trp
  misc_feature (10)..(10): Xaa can be Ala, Cys, Asp, Glu, Phe, Gly, His, Ile, Leu, Met, Asn, Pro, Ser, Thr, or Val
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
KLVVXGAXDXGKXALTIQL

SEQ ID NO: 27192 - protein, 20 aa, Artificial Sequence
  Description of Artificial Sequence: Synthetic peptide
  Seed: KLVVVGAGDVGKSALTIQLI (KRAS G13D)
  Core: LVVVGAGDV
  misc_feature (2)..(2): Xaa can be Ala, Cys, Glu, Phe, His, Ile, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXGDXGKSALTIQLI

SEQ ID NO: 27193 - protein, 20 aa, Artificial Sequence
  Description of Artificial Sequence: Synthetic peptide
  Seed: KLVVVGAGDVGKSALTIQLI (KRAS G13D)
  Core: VVVGAGDVG
  misc_feature (3)..(3): Xaa can be Ala, Cys, Asp, Glu, Phe, His, Ile, Leu, Met, Asn, Pro, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Gly, His, Ile, Lys, Leu, Met, Asn, Pro, Gln, Arg, Ser, Thr, or Val
  misc_feature (11)..(11): Xaa can be Ala, Cys, Asp, Glu, Gly, His, Ile, Lys, Leu, Met, Asn, Pro, Gln, Arg, Ser, Thr, Val, Trp, or Tyr
KLXVVXAXDVXKSALTIQLI

SEQ ID NO: 27194 - protein, 20 aa, Artificial Sequence
  Description of Artificial Sequence: Synthetic peptide
  Seed: KLVVVGAGDVGKSALTIQLI (KRAS G13D)
  Core: VGAGDVGKS
  misc_feature (5)..(5): Xaa can be Ala, Cys, Asp, Glu, Phe, His, Ile, Lys, Leu, Met, Asn, Pro, Gln, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (10)..(10): Xaa can be Ala, Cys, Asp, Glu, Phe, Gly, Ile, Leu, Met, Asn, Pro, Ser, Thr, Val, or Trp
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KLVVXGAXDXGKXALTIQLI

SEQ ID NO: 27195 - protein, 21 aa, Artificial Sequence
  Description of Artificial Sequence: Synthetic peptide
  Seed: KLVVVGAGDVGKSALTIQLIQ (KRAS G13D)
  Core: LVVVGAGDV
  misc_feature (2)..(2): Xaa can be Ala, Cys, Phe, His, Ile, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXVVXGXGDXGKSALTIQLIQ

SEQ ID NO: 27196 - protein, 21 aa, Artificial Sequence
  Description of Artificial Sequence: Synthetic peptide
  Seed: KLVVVGAGDVGKSALTIQLIQ (KRAS G13D)
  Core: VGAGDVGKS
  misc_feature (5)..(5): Xaa can be Ala, Cys, Asp, Glu, Phe, His, Ile, Lys, Leu, Met, Asn, Pro, Gln, Ser, Thr, Val, Trp, or Ty r
  misc_feature (8)..(8): Xaa can be Ala, Cys, Phe, Gly, His, Ile, Leu, Met, Asn, Pro, Ser, Thr, Val, Trp, or Tyr
  misc_feature (10)..(10): Xaa can be Ala, Cys, Asp, Glu, Phe, Gly, Ile, Leu, Met, Asn, Pro, Ser, Thr, or Val
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
KLVVXGAXDXGKXALTIQLIQ

SEQ ID NO: 27197 - protein, 22 aa, Artificial Sequence
  Description of Artificial Sequence: Synthetic peptide
  Seed: KLVVVGAGDVGKSALTIQLIQN (KRAS G13D)
  Core: LVVVGAGDV
  misc_feature (2)..(2): Xaa can be Ala, Cys, Phe, His, Ile, Leu, Met, Asn, Gln, Ser, Thr, Val, Trp, or Tyr
  misc_feature (5)..(5): Xaa can be Ala, Cys, Asp, Glu, Phe, His, Ile, Leu, Met, Asn, Gln, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Leu, Met, Asn, Pro, Gln, Arg, Ser, Thr, Val, Trp, or Tyr
KXVVXGXGDXGKSALTIQLIQN

SEQ ID NO: 27198 - protein, 22 aa, Artificial Sequence
  Description of Artificial Sequence: Synthetic peptide
  Seed: KLVVVGAGDVGKSALTIQLIQN (KRAS G13D)
  Core: VGAGDVGKS
  misc_feature (5)..(5): Xaa can be Ala, Cys, Asp, Glu, Phe, His, Ile, Lys, Leu, Met, Asn, Pro, Gln, Ser, Thr, Val, Trp, or Ty r
  misc_feature (8)..(8): Xaa can be Ala, Cys, Phe, Gly, His, Ile, Leu, Met, Asn, Pro, Ser, Thr, Val, Trp, or Tyr
  misc_feature (10)..(10): Xaa can be Ala, Cys, Asp, Glu, Phe, Gly, Ile, Leu, Met, Asn, Pro, Ser, Thr, or Val
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
KLVVXGAXDXGKXALTIQLIQN

SEQ ID NO: 27199 - protein, 23 aa, Artificial Sequence
  Description of Artificial Sequence: Synthetic peptide
  Seed: KLVVVGAGDVGKSALTIQLIQNH (KRAS G13D)
  Core: VGAGDVGKS
  misc_feature (5)..(5): Xaa can be Ala, Cys, Asp, Glu, Phe, His, Ile, Lys, Leu, Met, Asn, Pro, Gln, Ser, Thr, Val, Trp, or Ty r
  misc_feature (8)..(8): Xaa can be Ala, Cys, Asp, Phe, Gly, His, Ile, Met, Asn, Ser, Thr, Val, or Trp
  misc_feature (10)..(10): Xaa can be Ala, Cys, Asp, Glu, Phe, Gly, Ile, Leu, Met, Asn, Pro, Ser, Thr, or Val
  misc_feature (13)..(13): Xaa can be Ala, Cys, Asp, Glu, Phe, Gly, His, Ile, Leu, Met, Asn, Pro, Gln, Ser, Thr, Val, Trp, or Ty r
KLVVXGAXDXGKXALTIQLIQNH

SEQ ID NO: 27200 - protein, 24 aa, Artificial Sequence
  Description of Artificial Sequence: Synthetic peptide
  Seed: KLVVVGAGDVGKSALTIQLIQNHF (KRAS G13D)
  Core: VGAGDVGKS
  misc_feature (5)..(5): Xaa can be Ala, Cys, Asp, Glu, Phe, His, Ile, Lys, Leu, Met, Asn, Pro, Gln, Ser, Thr, Val, Trp, or Ty r
  misc_feature (8)..(8): Xaa can be Ala, Cys, Asp, Phe, Gly, His, Ile, Met, Asn, Ser, Thr, Val, or Trp
  misc_feature (10)..(10): Xaa can be Ala, Cys, Asp, Glu, Phe, Gly, Ile, Leu, Met, Asn, Pro, Ser, Thr, or Val
  misc_feature (13)..(13): Xaa can be Ala, Cys, Asp, Glu, Phe, Gly, His, Ile, Leu, Met, Asn, Pro, Gln, Ser, Thr, Val, Trp, or Ty r
KLVVXGAXDXGKXALTIQLIQNHF

SEQ ID NO: 27201 - protein, 25 aa, Artificial Sequence
  Description of Artificial Sequence: Synthetic peptide
  Seed: KLVVVGAGDVGKSALTIQLIQNHFV (KRAS G13D)
  Core: VGAGDVGKS
  misc_feature (5)..(5): Xaa can be Ala, Cys, Asp, Glu, Phe, His, Ile, Lys, Leu, Met, Asn, Pro, Gln, Ser, Thr, Val, Trp, or Ty r
  misc_feature (8)..(8): Xaa can be Ala, Cys, Asp, Gly, His, Ile, Met, Asn, Ser, Thr, Val, or Trp
  misc_feature (10)..(10): Xaa can be Ala, Cys, Asp, Glu, Phe, Gly, Ile, Leu, Met, Asn, Pro, Ser, Thr, or Val
  misc_feature (13)..(13): Xaa can be Ala, Cys, Asp, Glu, Phe, Gly, His, Ile, Leu, Met, Asn, Pro, Gln, Ser, Thr, Val, Trp, or Ty r
KLVVXGAXDXGKXALTIQLIQNHFV

SEQ ID NO: 27202 - protein, 13 aa, Artificial Sequence
  Description of Artificial Sequence: Synthetic peptide
  Seed: LVVVGAGDVGKSA (KRAS G13D)
  Core: VGAGDVGKS
  misc_feature (4)..(4): Xaa can be Ala, Cys, Asp, Glu, Phe, His, Ile, Leu, Met, Asn, Pro, Gln, Ser, Thr, Val, Trp, or Tyr
  misc_feature (7)..(7): Xaa can be Ala, Gly, Ile, Ser, Thr, Val, or Trp
  misc_feature (9)..(9): Xaa can be Ala, Cys, Gly, Ile, Leu, Met, Pro, Ser, Thr, or Val
  misc_feature (12)..(12): Xaa can be Ala, Cys, Asp, Glu, Phe, Gly, His, Ile, Leu, Met, Asn, Pro, Gln, Ser, Thr, Val, Trp, or Ty r
LVVXGAXDXGKXA

SEQ ID NO: 27203 - protein, 14 aa, Artificial Sequence
  Description of Artificial Sequence: Synthetic peptide
  Seed: LVVVGAGDVGKSAL (KRAS G13D)
  Core: VGAGDVGKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Phe, Gly, His, Ile, Leu, Met, Asn, Pro, Gln, Ser, Thr, Val, Trp, or Tyr
  misc_feature (9)..(9): Xaa can be Ala, Cys, Glu, Phe, Gly, Ile, Leu, Met, Asn, Pro, Gln, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVVXGAXDXGKXAL

SEQ ID NO: 27204 - protein, 15 aa, Artificial Sequence
  Description of Artificial Sequence: Synthetic peptide
  Seed: LVVVGAGDVGKSALT (KRAS G13D)
  Core: VGAGDVGKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVVXGAXDXGKXALT

SEQ ID NO: 27205 - protein, 16 aa, Artificial Sequence
  Description of Artificial Sequence: Synthetic peptide
  Seed: LVVVGAGDVGKSALTI (KRAS G13D)
  Core: VGAGDVGKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVVXGAXDXGKXALTI

SEQ ID NO: 27206 - protein, 17 aa, Artificial Sequence
  Description of Artificial Sequence: Synthetic peptide
  Seed: LVVVGAGDVGKSALTIQ (KRAS G13D)
  Core: VGAGDVGKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Glu, Phe, Gly, His, Ile, Lys, Leu, Met, Asn, Pro, Gln, Ser, Thr, Val, Trp, or Ty r
  misc_feature (9)..(9): Xaa can be Ala, Cys, Asp, Glu, Phe, Gly, Ile, Leu, Met, Asn, Pro, Gln, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVVXGAXDXGKXALTIQ

SEQ ID NO: 27207 - protein, 18 aa, Artificial Sequence
  Description of Artificial Sequence: Synthetic peptide
  Seed: LVVVGAGDVGKSALTIQL (KRAS G13D)
  Core: VGAGDVGKS
  misc_feature (4)..(4): Xaa can be Ala, Cys, Asp, Glu, Phe, Gly, His, Ile, Leu, Met, Asn, Pro, Gln, Ser, Thr, Val, Trp, or Ty r
  misc_feature (7)..(7): Xaa can be Ala, Cys, Gly, Ile, Met, Asn, Ser, Thr, or Val
  misc_feature (9)..(9): Xaa can be Ala, Cys, Phe, Gly, Ile, Leu, Met, Pro, Ser, Thr, or Val
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
LVVXGAXDXGKXALTIQL

SEQ ID NO: 27208 - protein, 19 aa, Artificial Sequence
  Description of Artificial Sequence: Synthetic peptide
  Seed: LVVVGAGDVGKSALTIQLI (KRAS G13D)
  Core: VGAGDVGKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, Ile, Leu, Met, Asn, Pro, Gln, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVVXGAXDXGKXALTIQLI

SEQ ID NO: 27209 - protein, 20 aa, Artificial Sequence
  Description of Artificial Sequence: Synthetic peptide
  Seed: LVVVGAGDVGKSALTIQLIQ (KRAS G13D)
  Core: VGAGDVGKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVVXGAXDXGKXALTIQLIQ

SEQ ID NO: 27210 - protein, 21 aa, Artificial Sequence
  Description of Artificial Sequence: Synthetic peptide
  Seed: LVVVGAGDVGKSALTIQLIQN (KRAS G13D)
  Core: VGAGDVGKS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Phe, Gly, His, Ile, Met, Asn, Ser, Thr, Val, or Trp
  misc_feature (9)..(9): Xaa can be Ala, Cys, Asp, Glu, Phe, Gly, Ile, Leu, Met, Asn, Pro, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LVVXGAXDXGKXALTIQLIQN

SEQ ID NO: 27211 - protein, 22 aa, Artificial Sequence
  Description of Artificial Sequence: Synthetic peptide
  Seed: LVVVGAGDVGKSALTIQLIQNH (KRAS G13D)
  Core: VGAGDVGKS
  misc_feature (4)..(4): Xaa can be Ala, Cys, Asp, Glu, Phe, His, Ile, Lys, Leu, Met, Asn, Pro, Gln, Arg, Ser, Thr, Val, Trp, or Tyr
  misc_feature (7)..(7): Xaa can be Ala, Cys, Gly, His, Ile, Met, Asn, Ser, Thr, Val, or Trp
  misc_feature (9)..(9): Xaa can be Ala, Cys, Asp, Glu, Phe, Gly, Ile, Leu, Met, Asn, Pro, Ser, Thr, or Val
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
LVVXGAXDXGKXALTIQLIQNH

SEQ ID NO: 27212 - protein, 23 aa, Artificial Sequence
  Description of Artificial Sequence: Synthetic peptide
  Seed: LVVVGAGDVGKSALTIQLIQNHF (KRAS G13D)
  Core: VGAGDVGKS
  misc_feature (4)..(4): Xaa can be Ala, Cys, Asp, Glu, Phe, His, Ile, Lys, Leu, Met, Asn, Pro, Gln, Arg, Ser, Thr, Val, Trp, or Tyr
  misc_feature (7)..(7): Xaa can be Ala, Cys, Gly, His, Ile, Met, Asn, Ser, Thr, Val, or Trp
  misc_feature (9)..(9): Xaa can be Ala, Cys, Asp, Glu, Phe, Gly, Ile, Leu, Met, Asn, Pro, Ser, Thr, or Val
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
LVVXGAXDXGKXALTIQLIQNHF

SEQ ID NO: 27213 - protein, 24 aa, Artificial Sequence
  Description of Artificial Sequence: Synthetic peptide
  Seed: LVVVGAGDVGKSALTIQLIQNHFV (KRAS G13D)
  Core: VGAGDVGKS
  misc_feature (4)..(4): Xaa can be Ala, Cys, Asp, Glu, Phe, His, Ile, Lys, Leu, Met, Asn, Pro, Gln, Arg, Ser, Thr, Val, Trp, or Tyr
  misc_feature (7)..(7): Xaa can be Ala, Cys, Gly, His, Ile, Met, Asn, Ser, Thr, or Val
  misc_feature (9)..(9): Xaa can be Ala, Cys, Asp, Glu, Phe, Gly, Ile, Leu, Met, Asn, Pro, Ser, Thr, or Val
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
LVVXGAXDXGKXALTIQLIQNHFV

SEQ ID NO: 27214 - protein, 25 aa, Artificial Sequence
  Description of Artificial Sequence: Synthetic peptide
  Seed: LVVVGAGDVGKSALTIQLIQNHFVD (KRAS G13D)
  Core: VGAGDVGKS
  misc_feature (4)..(4): Xaa can be Ala, Cys, Asp, Glu, Phe, His, Ile, Lys, Leu, Met, Asn, Pro, Gln, Arg, Ser, Thr, Val, Trp, or Tyr
  misc_feature (7)..(7): Xaa can be Ala, Cys, Gly, His, Ile, Met, Asn, Ser, Thr, or Val
  misc_feature (9)..(9): Xaa can be Ala, Cys, Asp, Glu, Phe, Gly, Ile, Leu, Met, Asn, Pro, Ser, Thr, or Val
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
LVVXGAXDXGKXALTIQLIQNHFVD

SEQ ID NO: 27215 - protein, 14 aa, Artificial Sequence
  Description of Artificial Sequence: Synthetic peptide
  Seed: MTEYKLVVVGAGDV (KRAS G13D)
  Core: LVVVGAGDV
  misc_feature (6)..(6): Xaa can be Phe, Ile, Leu, Met, Val, Trp, or Tyr
  misc_feature (9)..(9): Xaa can be Ala, Asp, Glu, His, Ile, Leu, Met, Asn, Gln, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Phe, Gly, His, Ile, Leu, Met, Asn, Gln, Arg, Ser, Thr, Val, Trp, or Tyr
MTEYKXVVXGXGDX

SEQ ID NO: 27216 - protein, 15 aa, Artificial Sequence
  Description of Artificial Sequence: Synthetic peptide
  Seed: MTEYKLVVVGAGDVG (KRAS G13D)
  Core: LVVVGAGDV
  misc_feature (6)..(6): Xaa can be Ala, Cys, Phe, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXG

SEQ ID NO: 27217 - protein, 16 aa, Artificial Sequence
  Description of Artificial Sequence: Synthetic peptide
  Seed: MTEYKLVVVGAGDVGK (KRAS G13D)
  Core: LVVVGAGDV
  misc_feature (6)..(6): Xaa can be Ala, Cys, Phe, His, Ile, Lys, Leu, Met, Asn, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGK

SEQ ID NO: 27218 - protein, 17 aa, Artificial Sequence
  Description of Artificial Sequence: Synthetic peptide
  Seed: MTEYKLVVVGAGDVGKS (KRAS G13D)
  Core: LVVVGAGDV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGKS

SEQ ID NO: 27219 - protein, 17 aa, Artificial Sequence
  Description of Artificial Sequence: Synthetic peptide
  Seed: MTEYKLVVVGAGDVGKS (KRAS G13D)
  Core: VGAGDVGKS
  misc_feature (9)..(9): Xaa can be Glu, Phe, Ile, Leu, Met, Pro, Gln, Val, Trp, or Tyr
  misc_feature (12)..(12): Xaa can be Ala, Gly, Ser, or Trp
  misc_feature (14)..(14): Xaa can be Ala, Cys, Ile, Leu, Met, Pro, Ser, Thr, or Val
  misc_feature (17)..(17): Xaa can be Ala, Cys, Asp, Glu, Phe, Gly, His, Ile, Leu, Met, Asn, Gln, Ser, Thr, Val, Trp, or Tyr
MTEYKLVVXGAXDXGKX

SEQ ID NO: 27220 - protein, 18 aa, Artificial Sequence
  Description of Artificial Sequence: Synthetic peptide
  Seed: MTEYKLVVVGAGDVGKSA (KRAS G13D)
  Core: LVVVGAGDV
  misc_feature (6)..(6): Xaa can be Ala, Cys, Phe, Ile, Leu, Met, Asn, Val, Trp, or Tyr
  misc_feature (9)..(9): Xaa can be Ala, Cys, Glu, Phe, Gly, His, Ile, Lys, Leu, Met, Asn, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGKSA

SEQ ID NO: 27221 - protein, 18 aa, Artificial Sequence
  Description of Artificial Sequence: Synthetic peptide
  Seed: MTEYKLVVVGAGDVGKSA (KRAS G13D)
  Core: VGAGDVGKS
  misc_feature (9)..(9): Xaa can be Ala, Cys, Glu, Phe, His, Ile, Leu, Met, Asn, Pro, Gln, Ser, Thr, Val, Trp, or Tyr
  misc_feature (12)..(12): Xaa can be Ala, Gly, Ile, Met, Asn, Ser, Thr, or Val
  misc_feature (14)..(14): Xaa can be Ala, Cys, Gly, Ile, Leu, Met, Pro, Ser, Thr, or Val
  misc_feature (17)..(17): Xaa can be Ala, Cys, Asp, Glu, Phe, Gly, His, Ile, Leu, Met, Asn, Pro, Gln, Ser, Thr, Val, Trp, or Ty r
MTEYKLVVXGAXDXGKXA

SEQ ID NO: 27222 - protein, 19 aa, Artificial Sequence
  Description of Artificial Sequence: Synthetic peptide
  Seed: MTEYKLVVVGAGDVGKSAL (KRAS G13D)
  Core: LVVVGAGDV
  misc_feature (6)..(6): Xaa can be Ala, Cys, Asp, Glu, Phe, His, Ile, Lys, Leu, Met, Asn, Gln, Arg, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGKSAL

SEQ ID NO: 27223 - protein, 19 aa, Artificial Sequence
  Description of Artificial Sequence: Synthetic peptide
  Seed: MTEYKLVVVGAGDVGKSAL (KRAS G13D)
  Core: VGAGDVGKS
  misc_feature (9)..(9): Xaa can be Ala, Cys, Asp, Glu, Phe, His, Ile, Lys, Leu, Met, Asn, Pro, Gln, Ser, Thr, Val, Trp, or Ty r
  misc_feature (12)..(12): Xaa can be Ala, Cys, Phe, Gly, Ile, Met, Asn, Ser, Thr, Val, or Trp
  misc_feature (14)..(14): Xaa can be Ala, Cys, Asp, Gly, Ile, Leu, Met, Asn, Pro, Ser, Thr, or Val
  misc_feature (17)..(17): Xaa can be Ala, Cys, Asp, Glu, Phe, Gly, His, Ile, Leu, Met, Asn, Pro, Gln, Ser, Thr, Val, Trp, or Ty r
MTEYKLVVXGAXDXGKXAL

SEQ ID NO: 27224 - protein, 20 aa, Artificial Sequence
  Description of Artificial Sequence: Synthetic peptide
  Seed: MTEYKLVVVGAGDVGKSALT (KRAS G13D)
  Core: LVVVGAGDV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGKSALT

SEQ ID NO: 27225 - protein, 20 aa, Artificial Sequence
  Description of Artificial Sequence: Synthetic peptide
  Seed: MTEYKLVVVGAGDVGKSALT (KRAS G13D)
  Core: VGAGDVGKS
  misc_feature (9)..(9): Xaa can be Ala, Cys, Asp, Glu, Phe, His, Ile, Lys, Leu, Met, Asn, Pro, Gln, Ser, Thr, Val, Trp, or Ty r
  misc_feature (12)..(12): Xaa can be Ala, Cys, Asp, Phe, Gly, His, Ile, Leu, Met, Asn, Gln, Ser, Thr, Val, Trp, or Tyr
  misc_feature (14)..(14): Xaa can be Ala, Cys, Asp, Glu, Phe, Gly, Ile, Leu, Met, Asn, Pro, Ser, Thr, or Val
  misc_feature (17)..(17): Xaa can be Ala, Cys, Asp, Glu, Phe, Gly, His, Ile, Leu, Met, Asn, Pro, Gln, Arg, Ser, Thr, Val, Trp, or Tyr
MTEYKLVVXGAXDXGKXALT

SEQ ID NO: 27226 - protein, 21 aa, Artificial Sequence
  Description of Artificial Sequence: Synthetic peptide
  Seed: MTEYKLVVVGAGDVGKSALTI (KRAS G13D)
  Core: LVVVGAGDV
  misc_feature (6)..(6): Xaa can be Ala, Cys, Glu, Phe, His, Ile, Lys, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGKSALTI

SEQ ID NO: 27227 - protein, 21 aa, Artificial Sequence
  Description of Artificial Sequence: Synthetic peptide
  Seed: MTEYKLVVVGAGDVGKSALTI (KRAS G13D)
  Core: VGAGDVGKS
  misc_feature (9)..(9): Xaa can be Ala, Cys, Asp, Glu, Phe, His, Ile, Lys, Leu, Met, Asn, Pro, Gln, Ser, Thr, Val, Trp, or Ty r
  misc_feature (12)..(12): Xaa can be Ala, Cys, Phe, Gly, His, Ile, Leu, Met, Asn, Pro, Ser, Thr, Val, or Trp
  misc_feature (14)..(14): Xaa can be Ala, Cys, Asp, Glu, Gly, Ile, Leu, Met, Asn, Pro, Ser, Thr, or Val
  misc_feature (17)..(17): Xaa can be Ala, Cys, Asp, Glu, Phe, Gly, His, Ile, Leu, Met, Asn, Pro, Gln, Arg, Ser, Thr, Val, Trp, or Tyr
MTEYKLVVXGAXDXGKXALTI

SEQ ID NO: 27228 - protein, 22 aa, Artificial Sequence
  Description of Artificial Sequence: Synthetic peptide
  Seed: MTEYKLVVVGAGDVGKSALTIQ (KRAS G13D)
  Core: LVVVGAGDV
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGKSALTIQ

SEQ ID NO: 27229 - protein, 22 aa, Artificial Sequence
  Description of Artificial Sequence: Synthetic peptide
  Seed: MTEYKLVVVGAGDVGKSALTIQ (KRAS G13D)
  Core: VGAGDVGKS
  misc_feature (9)..(9): Xaa can be Ala, Cys, Asp, Glu, Phe, His, Ile, Lys, Leu, Met, Asn, Pro, Gln, Ser, Thr, Val, Trp, or Ty r
  misc_feature (12)..(12): Xaa can be Ala, Cys, Phe, Gly, His, Ile, Leu, Met, Asn, Pro, Ser, Thr, Val, or Trp
  misc_feature (14)..(14): Xaa can be Ala, Cys, Asp, Glu, Gly, Ile, Leu, Met, Asn, Pro, Ser, Thr, or Val
  misc_feature (17)..(17): Xaa can be Ala, Cys, Asp, Glu, Phe, Gly, His, Ile, Leu, Met, Asn, Pro, Gln, Arg, Ser, Thr, Val, Trp, or Tyr
MTEYKLVVXGAXDXGKXALTIQ

SEQ ID NO: 27230 - protein, 23 aa, Artificial Sequence
  Description of Artificial Sequence: Synthetic peptide
  Seed: MTEYKLVVVGAGDVGKSALTIQL (KRAS G13D)
  Core: LVVVGAGDV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGKSALTIQL

SEQ ID NO: 27231 - protein, 23 aa, Artificial Sequence
  Description of Artificial Sequence: Synthetic peptide
  Seed: MTEYKLVVVGAGDVGKSALTIQL (KRAS G13D)
  Core: VGAGDVGKS
  misc_feature (9)..(9): Xaa can be Ala, Cys, Asp, Glu, Phe, His, Ile, Lys, Leu, Met, Asn, Pro, Gln, Ser, Thr, Val, Trp, or Ty r
  misc_feature (12)..(12): Xaa can be Ala, Cys, Phe, Gly, His, Ile, Leu, Met, Asn, Pro, Ser, Thr, Val, or Trp
  misc_feature (14)..(14): Xaa can be Ala, Cys, Asp, Glu, Gly, Ile, Leu, Met, Asn, Pro, Ser, Thr, or Val
  misc_feature (17)..(17): Xaa can be Ala, Cys, Asp, Glu, Phe, Gly, His, Ile, Leu, Met, Asn, Pro, Gln, Arg, Ser, Thr, Val, Trp, or Tyr
MTEYKLVVXGAXDXGKXALTIQL

SEQ ID NO: 27232 - protein, 24 aa, Artificial Sequence
  Description of Artificial Sequence: Synthetic peptide
  Seed: MTEYKLVVVGAGDVGKSALTIQLI (KRAS G13D)
  Core: LVVVGAGDV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGKSALTIQLI

SEQ ID NO: 27233 - protein, 24 aa, Artificial Sequence
  Description of Artificial Sequence: Synthetic peptide
  Seed: MTEYKLVVVGAGDVGKSALTIQLI (KRAS G13D)
  Core: VGAGDVGKS
  misc_feature (9)..(9): Xaa can be Ala, Cys, Asp, Glu, Phe, His, Ile, Lys, Leu, Met, Asn, Pro, Gln, Ser, Thr, Val, Trp, or Ty r
  misc_feature (12)..(12): Xaa can be Ala, Cys, Phe, Gly, His, Ile, Leu, Met, Asn, Pro, Ser, Thr, Val, or Trp
  misc_feature (14)..(14): Xaa can be Ala, Cys, Asp, Glu, Gly, Ile, Leu, Met, Asn, Pro, Ser, Thr, or Val
  misc_feature (17)..(17): Xaa can be Ala, Cys, Asp, Glu, Phe, Gly, His, Ile, Leu, Met, Asn, Pro, Gln, Arg, Ser, Thr, Val, Trp, or Tyr
MTEYKLVVXGAXDXGKXALTIQLI

SEQ ID NO: 27234 - protein, 25 aa, Artificial Sequence
  Description of Artificial Sequence: Synthetic peptide
  Seed: MTEYKLVVVGAGDVGKSALTIQLIQ (KRAS G13D)
  Core: LVVVGAGDV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
MTEYKXVVXGXGDXGKSALTIQLIQ

SEQ ID NO: 27235 - protein, 25 aa, Artificial Sequence
  Description of Artificial Sequence: Synthetic peptide
  Seed: MTEYKLVVVGAGDVGKSALTIQLIQ (KRAS G13D)
  Core: VGAGDVGKS
  misc_feature (9)..(9): Xaa can be Ala, Cys, Asp, Glu, Phe, His, Ile, Lys, Leu, Met, Asn, Pro, Gln, Ser, Thr, Val, Trp, or Ty r
  misc_feature (12)..(12): Xaa can be Ala, Cys, Asp, Phe, Gly, His, Ile, Leu, Met, Asn, Pro, Ser, Thr, Val, Trp, or Tyr
  misc_feature (14)..(14): Xaa can be Ala, Cys, Asp, Glu, Phe, Gly, Ile, Leu, Met, Asn, Pro, Ser, Thr, or Val
  misc_feature (17)..(17): Xaa can be Ala, Cys, Asp, Glu, Phe, Gly, His, Ile, Leu, Met, Asn, Pro, Gln, Arg, Ser, Thr, Val, Trp, or Tyr
MTEYKLVVXGAXDXGKXALTIQLIQ

SEQ ID NO: 27236 - protein, 14 aa, Artificial Sequence
  Description of Artificial Sequence: Synthetic peptide
  Seed: TEYKLVVVGAGDVG (KRAS G13D)
  Core: LVVVGAGDV
  misc_feature (5)..(5): Xaa can be Cys, Phe, Ile, Leu, Met, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXG

SEQ ID NO: 27237 - protein, 15 aa, Artificial Sequence
  Description of Artificial Sequence: Synthetic peptide
  Seed: TEYKLVVVGAGDVGK (KRAS G13D)
  Core: LVVVGAGDV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGK

SEQ ID NO: 27238 - protein, 16 aa, Artificial Sequence
  Description of Artificial Sequence: Synthetic peptide
  Seed: TEYKLVVVGAGDVGKS (KRAS G13D)
  Core: LVVVGAGDV
  misc_feature (5)..(5): Xaa can be Ala, Cys, Glu, Phe, His, Ile, Lys, Leu, Met, Asn, Pro, Gln, Arg, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKS

SEQ ID NO: 27239 - protein, 16 aa, Artificial Sequence
  Description of Artificial Sequence: Synthetic peptide
  Seed: TEYKLVVVGAGDVGKS (KRAS G13D)
  Core: VGAGDVGKS
  misc_feature (8)..(8): Xaa can be Glu, Phe, Ile, Leu, Met, Pro, Gln, Thr, Val, Trp, or Tyr
  misc_feature (11)..(11): Xaa can be Ala, Gly, Ser, or Trp
  misc_feature (13)..(13): Xaa can be Ala, Cys, Gly, Ile, Leu, Met, Pro, Ser, Thr, or Val
  misc_feature (16)..(16): Xaa can be Ala, Cys, Asp, Glu, Phe, Gly, His, Ile, Leu, Met, Asn, Gln, Ser, Thr, Val, Trp, or Tyr
TEYKLVVXGAXDXGKX

SEQ ID NO: 27240 - protein, 17 aa, Artificial Sequence
  Description of Artificial Sequence: Synthetic peptide
  Seed: TEYKLVVVGAGDVGKSA (KRAS G13D)
  Core: LVVVGAGDV
  misc_feature (5)..(5): Xaa can be Ala, Cys, Phe, His, Ile, Lys, Leu, Met, Asn, Gln, Arg, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKSA

SEQ ID NO: 27241 - protein, 17 aa, Artificial Sequence
  Description of Artificial Sequence: Synthetic peptide
  Seed: TEYKLVVVGAGDVGKSA (KRAS G13D)
  Core: VVVGAGDVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLXVVXAXDVXKSA

SEQ ID NO: 27242 - protein, 17 aa, Artificial Sequence
  Description of Artificial Sequence: Synthetic peptide
  Seed: TEYKLVVVGAGDVGKSA (KRAS G13D)
  Core: VGAGDVGKS
  misc_feature (8)..(8): Xaa can be Ala, Cys, Asp, Glu, Phe, His, Ile, Lys, Leu, Met, Asn, Pro, Gln, Ser, Thr, Val, Trp, or Ty r
  misc_feature (11)..(11): Xaa can be Ala, Cys, Phe, Gly, Ile, Met, Asn, Ser, Thr, Val, or Trp
  misc_feature (13)..(13): Xaa can be Ala, Cys, Asp, Glu, Phe, Gly, Ile, Leu, Met, Asn, Pro, Ser, Thr, or Val
  misc_feature (16)..(16): Xaa can be Ala, Cys, Asp, Glu, Phe, Gly, His, Ile, Leu, Met, Asn, Pro, Gln, Ser, Thr, Val, Trp, or Ty r
TEYKLVVXGAXDXGKXA

SEQ ID NO: 27243 - protein, 18 aa, Artificial Sequence
  Description of Artificial Sequence: Synthetic peptide
  Seed: TEYKLVVVGAGDVGKSAL (KRAS G13D)
  Core: LVVVGAGDV
  misc_feature (5)..(5): Xaa can be Cys, Phe, Ile, Leu, Met, Asn, Val, Trp, or Tyr
  misc_feature (8)..(8): Xaa can be Ala, Cys, Glu, Phe, Gly, His, Ile, Leu, Met, Asn, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKSAL

SEQ ID NO: 27244 - protein, 18 aa, Artificial Sequence
  Description of Artificial Sequence: Synthetic peptide
  Seed: TEYKLVVVGAGDVGKSAL (KRAS G13D)
  Core: VGAGDVGKS
  misc_feature (8)..(8): Xaa can be Ala, Cys, Glu, Phe, His, Ile, Leu, Met, Asn, Pro, Gln, Ser, Thr, Val, Trp, or Tyr
  misc_feature (11)..(11): Xaa can be Ala, Cys, Phe, Gly, Ile, Leu, Met, Asn, Ser, Thr, Val, or Trp
  misc_feature (13)..(13): Xaa can be Ala, Cys, Asp, Phe, Gly, Ile, Leu, Met, Pro, Ser, Thr, or Val
  misc_feature (16)..(16): Xaa can be Ala, Cys, Asp, Glu, Phe, Gly, His, Ile, Leu, Met, Asn, Pro, Gln, Ser, Thr, Val, Trp, or Ty r
TEYKLVVXGAXDXGKXAL

SEQ ID NO: 27245 - protein, 19 aa, Artificial Sequence
  Description of Artificial Sequence: Synthetic peptide
  Seed: TEYKLVVVGAGDVGKSALT (KRAS G13D)
  Core: LVVVGAGDV
  misc_feature (5)..(5): Xaa can be Ala, Cys, Glu, Phe, His, Ile, Leu, Met, Asn, Gln, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKSALT

SEQ ID NO: 27246 - protein, 19 aa, Artificial Sequence
  Description of Artificial Sequence: Synthetic peptide
  Seed: TEYKLVVVGAGDVGKSALT (KRAS G13D)
  Core: VGAGDVGKS
  misc_feature (8)..(8): Xaa can be Ala, Cys, Asp, Glu, Phe, His, Ile, Lys, Leu, Met, Asn, Pro, Gln, Ser, Thr, Val, Trp, or Ty r
  misc_feature (11)..(11): Xaa can be Ala, Cys, Asp, Phe, Gly, His, Ile, Leu, Met, Asn, Gln, Ser, Thr, Val, Trp, or Tyr
  misc_feature (13)..(13): Xaa can be Ala, Cys, Asp, Glu, Phe, Gly, Ile, Leu, Met, Asn, Pro, Ser, Thr, or Val
  misc_feature (16)..(16): Xaa can be Ala, Cys, Asp, Glu, Phe, Gly, His, Ile, Leu, Met, Asn, Pro, Gln, Ser, Thr, Val, Trp, or Ty r
TEYKLVVXGAXDXGKXALT

SEQ ID NO: 27247 - protein, 20 aa, Artificial Sequence
  Description of Artificial Sequence: Synthetic peptide
  Seed: TEYKLVVVGAGDVGKSALTI (KRAS G13D)
  Core: LVVVGAGDV
  misc_feature (5)..(5): Xaa can be Ala, Cys, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKSALTI

SEQ ID NO: 27248 - protein, 20 aa, Artificial Sequence
  Description of Artificial Sequence: Synthetic peptide
  Seed: TEYKLVVVGAGDVGKSALTI (KRAS G13D)
  Core: VVVGAGDVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLXVVXAXDVXKSALTI

SEQ ID NO: 27249 - protein, 20 aa, Artificial Sequence
  Description of Artificial Sequence: Synthetic peptide
  Seed: TEYKLVVVGAGDVGKSALTI (KRAS G13D)
  Core: VGAGDVGKS
  misc_feature (8)..(8): Xaa can be Ala, Cys, Asp, Glu, Phe, His, Ile, Lys, Leu, Met, Asn, Pro, Gln, Ser, Thr, Val, Trp, or Ty r
  misc_feature (11)..(11): Xaa can be Ala, Cys, Asp, Phe, Gly, His, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Leu, Met, Asn, Pro, Ser, Thr, or Val
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
TEYKLVVXGAXDXGKXALTI

SEQ ID NO: 27250 - protein, 21 aa, Artificial Sequence
  Description of Artificial Sequence: Synthetic peptide
  Seed: TEYKLVVVGAGDVGKSALTIQ (KRAS G13D)
  Core: LVVVGAGDV
  misc_feature (5)..(5): Xaa can be Ala, Cys, Glu, Phe, His, Ile, Lys, Leu, Met, Asn, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKSALTIQ

SEQ ID NO: 27251 - protein, 21 aa, Artificial Sequence
  Description of Artificial Sequence: Synthetic peptide
  Seed: TEYKLVVVGAGDVGKSALTIQ (KRAS G13D)
  Core: VGAGDVGKS
  misc_feature (8)..(8): Xaa can be Ala, Cys, Asp, Glu, Phe, His, Ile, Lys, Leu, Met, Asn, Pro, Gln, Ser, Thr, Val, Trp, or Ty r
  misc_feature (11)..(11): Xaa can be Ala, Cys, Phe, Gly, His, Ile, Leu, Met, Asn, Pro, Ser, Thr, Val, or Trp
  misc_feature (13)..(13): Xaa can be Ala, Cys, Asp, Glu, Gly, Ile, Leu, Met, Asn, Pro, Ser, Thr, or Val
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
TEYKLVVXGAXDXGKXALTIQ

SEQ ID NO: 27252 - protein, 22 aa, Artificial Sequence
  Description of Artificial Sequence: Synthetic peptide
  Seed: TEYKLVVVGAGDVGKSALTIQL (KRAS G13D)
  Core: LVVVGAGDV
  misc_feature (5)..(5): Xaa can be Ala, Cys, Glu, Phe, His, Ile, Lys, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKSALTIQL

SEQ ID NO: 27253 - protein, 22 aa, Artificial Sequence
  Description of Artificial Sequence: Synthetic peptide
  Seed: TEYKLVVVGAGDVGKSALTIQL (KRAS G13D)
  Core: VGAGDVGKS
  misc_feature (8)..(8): Xaa can be Ala, Cys, Asp, Glu, Phe, His, Ile, Lys, Leu, Met, Asn, Pro, Gln, Ser, Thr, Val, Trp, or Ty r
  misc_feature (11)..(11): Xaa can be Ala, Cys, Phe, Gly, His, Ile, Leu, Met, Asn, Pro, Ser, Thr, Val, or Trp
  misc_feature (13)..(13): Xaa can be Ala, Cys, Asp, Glu, Gly, Ile, Leu, Met, Asn, Pro, Ser, Thr, or Val
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
TEYKLVVXGAXDXGKXALTIQL

SEQ ID NO: 27254 - protein, 23 aa, Artificial Sequence
  Description of Artificial Sequence: Synthetic peptide
  Seed: TEYKLVVVGAGDVGKSALTIQLI (KRAS G13D)
  Core: LVVVGAGDV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKSALTIQLI

SEQ ID NO: 27255 - protein, 23 aa, Artificial Sequence
  Description of Artificial Sequence: Synthetic peptide
  Seed: TEYKLVVVGAGDVGKSALTIQLI (KRAS G13D)
  Core: VVVGAGDVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLXVVXAXDVXKSALTIQLI

SEQ ID NO: 27256 - protein, 23 aa, Artificial Sequence
  Description of Artificial Sequence: Synthetic peptide
  Seed: TEYKLVVVGAGDVGKSALTIQLI (KRAS G13D)
  Core: VGAGDVGKS
  misc_feature (8)..(8): Xaa can be Ala, Cys, Asp, Glu, Phe, His, Ile, Lys, Leu, Met, Asn, Pro, Gln, Ser, Thr, Val, Trp, or Ty r
  misc_feature (11)..(11): Xaa can be Ala, Cys, Phe, Gly, His, Ile, Leu, Met, Asn, Pro, Ser, Thr, Val, or Trp
  misc_feature (13)..(13): Xaa can be Ala, Cys, Asp, Glu, Gly, Ile, Leu, Met, Asn, Pro, Ser, Thr, or Val
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
TEYKLVVXGAXDXGKXALTIQLI

SEQ ID NO: 27257 - protein, 24 aa, Artificial Sequence
  Description of Artificial Sequence: Synthetic peptide
  Seed: TEYKLVVVGAGDVGKSALTIQLIQ (KRAS G13D)
  Core: LVVVGAGDV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKSALTIQLIQ

SEQ ID NO: 27258 - protein, 24 aa, Artificial Sequence
  Description of Artificial Sequence: Synthetic peptide
  Seed: TEYKLVVVGAGDVGKSALTIQLIQ (KRAS G13D)
  Core: VVVGAGDVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLXVVXAXDVXKSALTIQLIQ

SEQ ID NO: 27259 - protein, 24 aa, Artificial Sequence
  Description of Artificial Sequence: Synthetic peptide
  Seed: TEYKLVVVGAGDVGKSALTIQLIQ (KRAS G13D)
  Core: VGAGDVGKS
  misc_feature (8)..(8): Xaa can be Ala, Cys, Asp, Glu, Phe, His, Ile, Lys, Leu, Met, Asn, Pro, Gln, Ser, Thr, Val, Trp, or Ty r
  misc_feature (11)..(11): Xaa can be Ala, Cys, Phe, Gly, His, Ile, Leu, Met, Asn, Pro, Ser, Thr, Val, Trp, or Tyr
  misc_feature (13)..(13): Xaa can be Ala, Cys, Asp, Glu, Gly, Ile, Leu, Met, Asn, Pro, Ser, Thr, or Val
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
TEYKLVVXGAXDXGKXALTIQLIQ

SEQ ID NO: 27260 - protein, 25 aa, Artificial Sequence
  Description of Artificial Sequence: Synthetic peptide
  Seed: TEYKLVVVGAGDVGKSALTIQLIQN (KRAS G13D)
  Core: LVVVGAGDV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEYKXVVXGXGDXGKSALTIQLIQN

SEQ ID NO: 27261 - protein, 25 aa, Artificial Sequence
  Description of Artificial Sequence: Synthetic peptide
  Seed: TEYKLVVVGAGDVGKSALTIQLIQN (KRAS G13D)
  Core: VVVGAGDVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEYKLXVVXAXDVXKSALTIQLIQN

SEQ ID NO: 27262 - protein, 25 aa, Artificial Sequence
  Description of Artificial Sequence: Synthetic peptide
  Seed: TEYKLVVVGAGDVGKSALTIQLIQN (KRAS G13D)
  Core: VGAGDVGKS
  misc_feature (8)..(8): Xaa can be Ala, Cys, Asp, Glu, Phe, His, Ile, Lys, Leu, Met, Asn, Pro, Gln, Ser, Thr, Val, Trp, or Ty r
  misc_feature (11)..(11): Xaa can be Ala, Cys, Asp, Phe, Gly, His, Ile, Leu, Met, Asn, Ser, Thr, Val, Trp, or Tyr
  misc_feature (13)..(13): Xaa can be Ala, Cys, Asp, Glu, Phe, Gly, Ile, Leu, Met, Asn, Pro, Ser, Thr, or Val
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
TEYKLVVXGAXDXGKXALTIQLIQN

SEQ ID NO: 27263 - protein, 14 aa, Artificial Sequence
  Description of Artificial Sequence: Synthetic peptide
  Seed: VGAGDVGKSALTIQ (KRAS G13D)
  Core: VGAGDVGKS
  misc_feature (1)..(1): Xaa can be Phe, Ile, Val, Trp, or Tyr
  misc_feature (4)..(4): Xaa can be , or Gly
  misc_feature (6)..(6): Xaa can be Ala, Ile, or Val
  misc_feature (9)..(9): Xaa can be Gly, Asn, Ser, or Thr
XGAXDXGKXALTIQ

SEQ ID NO: 27264 - protein, 14 aa, Artificial Sequence
  Description of Artificial Sequence: Synthetic peptide
  Seed: VGAGDVGKSALTIQ (KRAS G13D)
  Core: GDVGKSALT
  misc_feature (4)..(4): Xaa can be Ala, Cys, Asp, Glu, Phe, Gly, His, Ile, Lys, Leu, Met, Asn, Pro, Gln, Ser, Thr, Val, Trp, or Tyr
  misc_feature (7)..(7): Xaa can be Ala, Cys, Glu, Phe, Gly, His, Ile, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGAXDVXKXALXIQ

SEQ ID NO: 27265 - protein, 15 aa, Artificial Sequence
  Description of Artificial Sequence: Synthetic peptide
  Seed: VGAGDVGKSALTIQL (KRAS G13D)
  Core: VGAGDVGKS
  misc_feature (1)..(1): Xaa can be Phe, Ile, Val, Trp, or Tyr
  misc_feature (4)..(4): Xaa can be , or Gly
  misc_feature (6)..(6): Xaa can be Ala, Ile, Pro, or Val
  misc_feature (9)..(9): Xaa can be Leu, Met, Asn, Ser, Thr, or Trp
XGAXDXGKXALTIQL

SEQ ID NO: 27266 - protein, 15 aa, Artificial Sequence
  Description of Artificial Sequence: Synthetic peptide
  Seed: VGAGDVGKSALTIQL (KRAS G13D)
  Core: GDVGKSALT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGAXDVXKXALXIQL

SEQ ID NO: 27267 - protein, 16 aa, Artificial Sequence
  Description of Artificial Sequence: Synthetic peptide
  Seed: VGAGDVGKSALTIQLI (KRAS G13D)
  Core: GDVGKSALT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGAXDVXKXALXIQLI

SEQ ID NO: 27268 - protein, 13 aa, Artificial Sequence
  Description of Artificial Sequence: Synthetic peptide
  Seed: VVGAGDVGKSALT (KRAS G13D)
  Core: VGAGDVGKS
  misc_feature (2)..(2): Xaa can be Ala, Cys, Glu, Phe, His, Ile, Leu, Met, Asn, Pro, Gln, Ser, Thr, Val, Trp, or Tyr
  misc_feature (5)..(5): Xaa can be Ala, Gly, Ser, or Thr
  misc_feature (7)..(7): Xaa can be Ala, Cys, Ile, Leu, Met, Pro, Ser, Thr, or Val
  misc_feature (10)..(10): Xaa can be Ala, Cys, Phe, Gly, His, Ile, Leu, Met, Asn, Pro, Gln, Ser, Thr, Val, Trp, or Tyr
VXGAXDXGKXALT

SEQ ID NO: 27269 - protein, 14 aa, Artificial Sequence
  Description of Artificial Sequence: Synthetic peptide
  Seed: VVGAGDVGKSALTI (KRAS G13D)
  Core: VGAGDVGKS
  misc_feature (2)..(2): Xaa can be Ala, Cys, Asp, Glu, Phe, His, Ile, Leu, Met, Asn, Pro, Gln, Ser, Thr, Val, Trp, or Tyr
  misc_feature (5)..(5): Xaa can be Ala, Cys, Gly, Ile, Met, Asn, Ser, Thr, or Val
  misc_feature (7)..(7): Xaa can be Ala, Cys, Gly, Ile, Leu, Met, Pro, Ser, Thr, or Val
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
VXGAXDXGKXALTI

SEQ ID NO: 27270 - protein, 15 aa, Artificial Sequence
  Description of Artificial Sequence: Synthetic peptide
  Seed: VVGAGDVGKSALTIQ (KRAS G13D)
  Core: VGAGDVGKS
  misc_feature (2)..(2): Xaa can be Ala, Cys, Asp, Glu, Phe, His, Ile, Leu, Met, Asn, Pro, Gln, Ser, Thr, Val, Trp, or Tyr
  misc_feature (5)..(5): Xaa can be Ala, Cys, Phe, Gly, His, Ile, Asn, Ser, Thr, Val, or Trp
  misc_feature (7)..(7): Xaa can be Ala, Cys, Gly, Ile, Leu, Met, Pro, Ser, Thr, or Val
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
VXGAXDXGKXALTIQ

SEQ ID NO: 27271 - protein, 16 aa, Artificial Sequence
  Description of Artificial Sequence: Synthetic peptide
  Seed: VVGAGDVGKSALTIQL (KRAS G13D)
  Core: VGAGDVGKS
  misc_feature (2)..(2): Xaa can be Ala, Cys, Asp, Glu, Phe, His, Ile, Leu, Met, Asn, Pro, Gln, Ser, Thr, Val, Trp, or Tyr
  misc_feature (5)..(5): Xaa can be Ala, Cys, Phe, Gly, His, Ile, Asn, Ser, Thr, Val, or Trp
  misc_feature (7)..(7): Xaa can be Ala, Cys, Gly, Ile, Leu, Met, Pro, Ser, Thr, or Val
  misc_feature (10)..(10): Xaa can be Ala, Cys, Asp, Glu, Phe, Gly, His, Ile, Leu, Met, Asn, Gln, Arg, Ser, Thr, Val, Trp, or Ty r
VXGAXDXGKXALTIQL

SEQ ID NO: 27272 - protein, 17 aa, Artificial Sequence
  Description of Artificial Sequence: Synthetic peptide
  Seed: VVGAGDVGKSALTIQLI (KRAS G13D)
  Core: VGAGDVGKS
  misc_feature (2)..(2): Xaa can be Ala, Cys, Asp, Glu, Phe, His, Ile, Leu, Met, Asn, Pro, Gln, Ser, Thr, Val, Trp, or Tyr
  misc_feature (5)..(5): Xaa can be Ala, Cys, Gly, Ile, Asn, Ser, Thr, Val, or Trp
  misc_feature (7)..(7): Xaa can be Ala, Cys, Ile, Leu, Met, Pro, Ser, Thr, or Val
  misc_feature (10)..(10): Xaa can be Ala, Cys, Asp, Glu, Phe, Gly, His, Ile, Leu, Met, Asn, Gln, Arg, Ser, Thr, Val, Trp, or Ty r
VXGAXDXGKXALTIQLI

SEQ ID NO: 27273 - protein, 18 aa, Artificial Sequence
  Description of Artificial Sequence: Synthetic peptide
  Seed: VVGAGDVGKSALTIQLIQ (KRAS G13D)
  Core: VGAGDVGKS
  misc_feature (2)..(2): Xaa can be Ala, Phe, Ile, Leu, Met, Pro, Val, Trp, or Tyr
  misc_feature (5)..(5): Xaa can be Ala, Gly, or Ser
  misc_feature (7)..(7): Xaa can be Ala, Cys, Ile, Leu, Pro, Ser, Thr, or Val
  misc_feature (10)..(10): Xaa can be Ala, Cys, Phe, Gly, His, Ile, Leu, Met, Asn, Ser, Thr, Val, Trp, or Tyr
VXGAXDXGKXALTIQLIQ

SEQ ID NO: 27274 - protein, 19 aa, Artificial Sequence
  Description of Artificial Sequence: Synthetic peptide
  Seed: VVGAGDVGKSALTIQLIQN (KRAS G13D)
  Core: VGAGDVGKS
  misc_feature (2)..(2): Xaa can be Ala, Phe, Ile, Leu, Met, Pro, Thr, Val, Trp, or Tyr
  misc_feature (5)..(5): Xaa can be Ala, Cys, Gly, Asn, or Ser
  misc_feature (7)..(7): Xaa can be Ala, Cys, Ile, Leu, Met, Pro, Ser, Thr, or Val
  misc_feature (10)..(10): Xaa can be Ala, Cys, Phe, Gly, His, Ile, Leu, Met, Asn, Gln, Ser, Thr, Val, Trp, or Tyr
VXGAXDXGKXALTIQLIQN

SEQ ID NO: 27275 - protein, 20 aa, Artificial Sequence
  Description of Artificial Sequence: Synthetic peptide
  Seed: VVGAGDVGKSALTIQLIQNH (KRAS G13D)
  Core: VGAGDVGKS
  misc_feature (2)..(2): Xaa can be Ala, Phe, Ile, Leu, Met, Pro, Thr, Val, Trp, or Tyr
  misc_feature (5)..(5): Xaa can be Ala, Gly, or Ser
  misc_feature (7)..(7): Xaa can be Ala, Cys, Ile, Leu, Pro, Ser, Thr, or Val
  misc_feature (10)..(10): Xaa can be Ala, Cys, Asp, Glu, Phe, Gly, His, Ile, Leu, Met, Asn, Gln, Ser, Thr, Val, Trp, or Tyr
VXGAXDXGKXALTIQLIQNH

SEQ ID NO: 27276 - protein, 21 aa, Artificial Sequence
  Description of Artificial Sequence: Synthetic peptide
  Seed: VVGAGDVGKSALTIQLIQNHF (KRAS G13D)
  Core: VGAGDVGKS
  misc_feature (2)..(2): Xaa can be Ala, Phe, Ile, Leu, Met, Pro, Val, Trp, or Tyr
  misc_feature (5)..(5): Xaa can be Ala, Gly, or Ser
  misc_feature (7)..(7): Xaa can be Ala, Ile, Pro, Ser, Thr, or Val
  misc_feature (10)..(10): Xaa can be Ala, Cys, Phe, Gly, Ile, Leu, Met, Asn, Ser, Thr, or Val
VXGAXDXGKXALTIQLIQNHF

SEQ ID NO: 27277 - protein, 22 aa, Artificial Sequence
  Description of Artificial Sequence: Synthetic peptide
  Seed: VVGAGDVGKSALTIQLIQNHFV (KRAS G13D)
  Core: VGAGDVGKS
  misc_feature (2)..(2): Xaa can be Ala, Phe, Ile, Leu, Met, Pro, Val, Trp, or Tyr
  misc_feature (5)..(5): Xaa can be Ala, Gly, or Ser
  misc_feature (7)..(7): Xaa can be Ala, Ile, Pro, Ser, Thr, or Val
  misc_feature (10)..(10): Xaa can be Ala, Cys, Phe, Gly, Ile, Leu, Met, Asn, Ser, Thr, Val, or Trp
VXGAXDXGKXALTIQLIQNHFV

SEQ ID NO: 27278 - protein, 23 aa, Artificial Sequence
  Description of Artificial Sequence: Synthetic peptide
  Seed: VVGAGDVGKSALTIQLIQNHFVD (KRAS G13D)
  Core: VGAGDVGKS
  misc_feature (2)..(2): Xaa can be Ala, Phe, Ile, Leu, Met, Pro, Val, Trp, or Tyr
  misc_feature (5)..(5): Xaa can be Ala, Gly, or Ser
  misc_feature (7)..(7): Xaa can be Ala, Ile, Pro, Ser, Thr, or Val
  misc_feature (10)..(10): Xaa can be Ala, Cys, Phe, Gly, Ile, Leu, Met, Asn, Ser, Thr, Val, or Trp
VXGAXDXGKXALTIQLIQNHFVD

SEQ ID NO: 27279 - protein, 24 aa, Artificial Sequence
  Description of Artificial Sequence: Synthetic peptide
  Seed: VVGAGDVGKSALTIQLIQNHFVDE (KRAS G13D)
  Core: VGAGDVGKS
  misc_feature (2)..(2): Xaa can be Ala, Phe, Ile, Leu, Met, Pro, Val, Trp, or Tyr
  misc_feature (5)..(5): Xaa can be Ala, Gly, or Ser
  misc_feature (7)..(7): Xaa can be Ala, Ile, Pro, Ser, Thr, or Val
  misc_feature (10)..(10): Xaa can be Ala, Cys, Phe, Gly, Ile, Leu, Met, Asn, Ser, Thr, Val, or Trp
VXGAXDXGKXALTIQLIQNHFVDE

SEQ ID NO: 27280 - protein, 25 aa, Artificial Sequence
  Description of Artificial Sequence: Synthetic peptide
  Seed: VVGAGDVGKSALTIQLIQNHFVDEY (KRAS G13D)
  Core: VGAGDVGKS
  misc_feature (2)..(2): Xaa can be Ala, Phe, Ile, Leu, Met, Pro, Val, Trp, or Tyr
  misc_feature (5)..(5): Xaa can be Ala, Gly, or Ser
  misc_feature (7)..(7): Xaa can be Ala, Ile, Pro, Ser, Thr, or Val
  misc_feature (10)..(10): Xaa can be Ala, Cys, Phe, Gly, Ile, Leu, Met, Asn, Ser, Thr, Val, Trp, or Tyr
VXGAXDXGKXALTIQLIQNHFVDEY

SEQ ID NO: 27281 - protein, 13 aa, Artificial Sequence
  Description of Artificial Sequence: Synthetic peptide
  Seed: VVVGAGDVGKSAL (KRAS G13D)
  Core: VGAGDVGKS
  misc_feature (3)..(3): Xaa can be Ala, Cys, Asp, Glu, Phe, His, Ile, Leu, Met, Asn, Pro, Gln, Ser, Thr, Val, Trp, or Tyr
  misc_feature (6)..(6): Xaa can be Ala, Gly, Ile, Ser, Thr, or Val
  misc_feature (8)..(8): Xaa can be Ala, Cys, Gly, Ile, Leu, Met, Pro, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
VVXGAXDXGKXAL

SEQ ID NO: 27282 - protein, 14 aa, Artificial Sequence
  Description of Artificial Sequence: Synthetic peptide
  Seed: VVVGAGDVGKSALT (KRAS G13D)
  Core: VGAGDVGKS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Phe, Gly, His, Ile, Leu, Met, Asn, Pro, Gln, Ser, Thr, Val, or Trp
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXGAXDXGKXALT

SEQ ID NO: 27283 - protein, 15 aa, Artificial Sequence
  Description of Artificial Sequence: Synthetic peptide
  Seed: VVVGAGDVGKSALTI (KRAS G13D)
  Core: VGAGDVGKS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Ser, Thr, Val, or Tr p
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXGAXDXGKXALTI

SEQ ID NO: 27284 - protein, 16 aa, Artificial Sequence
  Description of Artificial Sequence: Synthetic peptide
  Seed: VVVGAGDVGKSALTIQ (KRAS G13D)
  Core: VGAGDVGKS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Phe, Gly, His, Ile, Lys, Leu, Met, Asn, Pro, Ser, Thr, Val, Trp, or Tyr
  misc_feature (8)..(8): Xaa can be Ala, Cys, Glu, Phe, Gly, Ile, Leu, Met, Asn, Pro, Gln, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXGAXDXGKXALTIQ

SEQ ID NO: 27285 - protein, 17 aa, Artificial Sequence
  Description of Artificial Sequence: Synthetic peptide
  Seed: VVVGAGDVGKSALTIQL (KRAS G13D)
  Core: VGAGDVGKS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Phe, Gly, His, Ile, Lys, Leu, Met, Asn, Pro, Gln, Ser, Thr, Val, Trp, or Ty r
  misc_feature (8)..(8): Xaa can be Ala, Cys, Asp, Glu, Phe, Gly, His, Ile, Leu, Met, Asn, Pro, Gln, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXGAXDXGKXALTIQL

SEQ ID NO: 27286 - protein, 18 aa, Artificial Sequence
  Description of Artificial Sequence: Synthetic peptide
  Seed: VVVGAGDVGKSALTIQLI (KRAS G13D)
  Core: VGAGDVGKS
  misc_feature (3)..(3): Xaa can be Ala, Cys, Glu, Phe, His, Ile, Leu, Met, Asn, Pro, Gln, Ser, Thr, Val, Trp, or Tyr
  misc_feature (6)..(6): Xaa can be Ala, Cys, Gly, Ile, Ser, Thr, or Val
  misc_feature (8)..(8): Xaa can be Ala, Cys, Gly, Ile, Leu, Met, Pro, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
VVXGAXDXGKXALTIQLI

SEQ ID NO: 27287 - protein, 19 aa, Artificial Sequence
  Description of Artificial Sequence: Synthetic peptide
  Seed: VVVGAGDVGKSALTIQLIQ (KRAS G13D)
  Core: VGAGDVGKS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Phe, Gly, His, Ile, Leu, Met, Asn, Ser, Thr, Val, Trp, or Tyr
  misc_feature (8)..(8): Xaa can be Ala, Cys, Asp, Glu, Gly, Ile, Leu, Met, Asn, Pro, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXGAXDXGKXALTIQLIQ

SEQ ID NO: 27288 - protein, 20 aa, Artificial Sequence
  Description of Artificial Sequence: Synthetic peptide
  Seed: VVVGAGDVGKSALTIQLIQN (KRAS G13D)
  Core: VGAGDVGKS
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Phe, Gly, His, Ile, Leu, Met, Asn, Gln, Ser, Thr, Val, or Trp
  misc_feature (8)..(8): Xaa can be Ala, Cys, Asp, Glu, Gly, Ile, Leu, Met, Asn, Pro, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXGAXDXGKXALTIQLIQN

SEQ ID NO: 27289 - protein, 21 aa, Artificial Sequence
  Description of Artificial Sequence: Synthetic peptide
  Seed: VVVGAGDVGKSALTIQLIQNH (KRAS G13D)
  Core: VGAGDVGKS
  misc_feature (3)..(3): Xaa can be Ala, Cys, Glu, Phe, His, Ile, Leu, Met, Asn, Pro, Gln, Ser, Thr, Val, Trp, or Tyr
  misc_feature (6)..(6): Xaa can be Ala, Cys, Gly, Asn, Ser, or Thr
  misc_feature (8)..(8): Xaa can be Ala, Cys, Gly, Ile, Leu, Met, Pro, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
VVXGAXDXGKXALTIQLIQNH

SEQ ID NO: 27290 - protein, 22 aa, Artificial Sequence
  Description of Artificial Sequence: Synthetic peptide
  Seed: VVVGAGDVGKSALTIQLIQNHF (KRAS G13D)
  Core: VGAGDVGKS
  misc_feature (3)..(3): Xaa can be Ala, Cys, Glu, Phe, His, Ile, Leu, Met, Asn, Pro, Gln, Ser, Thr, Val, Trp, or Tyr
  misc_feature (6)..(6): Xaa can be Ala, Cys, Gly, Asn, Ser, or Thr
  misc_feature (8)..(8): Xaa can be Ala, Cys, Gly, Ile, Leu, Met, Pro, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
VVXGAXDXGKXALTIQLIQNHF

SEQ ID NO: 27291 - protein, 23 aa, Artificial Sequence
  Description of Artificial Sequence: Synthetic peptide
  Seed: VVVGAGDVGKSALTIQLIQNHFV (KRAS G13D)
  Core: VGAGDVGKS
  misc_feature (3)..(3): Xaa can be Ala, Cys, Glu, Phe, His, Ile, Leu, Met, Asn, Pro, Gln, Ser, Thr, Val, Trp, or Tyr
  misc_feature (6)..(6): Xaa can be Ala, Cys, Gly, Asn, Ser, or Thr
  misc_feature (8)..(8): Xaa can be Ala, Cys, Gly, Ile, Leu, Met, Pro, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
VVXGAXDXGKXALTIQLIQNHFV

SEQ ID NO: 27292 - protein, 24 aa, Artificial Sequence
  Description of Artificial Sequence: Synthetic peptide
  Seed: VVVGAGDVGKSALTIQLIQNHFVD (KRAS G13D)
  Core: VGAGDVGKS
  misc_feature (3)..(3): Xaa can be Ala, Cys, Glu, Phe, His, Ile, Leu, Met, Asn, Pro, Gln, Ser, Thr, Val, Trp, or Tyr
  misc_feature (6)..(6): Xaa can be Ala, Cys, Gly, Asn, Ser, or Thr
  misc_feature (8)..(8): Xaa can be Ala, Cys, Gly, Ile, Leu, Met, Pro, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
VVXGAXDXGKXALTIQLIQNHFVD

SEQ ID NO: 27293 - protein, 25 aa, Artificial Sequence
  Description of Artificial Sequence: Synthetic peptide
  Seed: VVVGAGDVGKSALTIQLIQNHFVDE (KRAS G13D)
  Core: VGAGDVGKS
  misc_feature (3)..(3): Xaa can be Ala, Cys, Glu, Phe, His, Ile, Leu, Met, Asn, Pro, Gln, Ser, Thr, Val, Trp, or Tyr
  misc_feature (6)..(6): Xaa can be Ala, Cys, Gly, Asn, Ser, or Thr
  misc_feature (8)..(8): Xaa can be Ala, Cys, Gly, Ile, Leu, Met, Pro, Ser, Thr, or Val
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
VVXGAXDXGKXALTIQLIQNHFVDE

SEQ ID NO: 27294 - protein, 13 aa, Artificial Sequence
  Description of Artificial Sequence: Synthetic peptide
  Seed: YKLVVVGAGDVGK (KRAS G13D)
  Core: LVVVGAGDV
  misc_feature (3)..(3): Xaa can be Cys, Phe, Ile, Leu, Met, Val, Trp, or Tyr
  misc_feature (6)..(6): Xaa can be Ala, Cys, Glu, Phe, Gly, His, Ile, Lys, Leu, Met, Asn, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Glu, Phe, Gly, His, Ile, Lys, Leu, Met, Asn, Pro, Gln, Arg, Ser, Thr, Val, Trp, or Tyr
YKXVVXGXGDXGK

SEQ ID NO: 27295 - protein, 14 aa, Artificial Sequence
  Description of Artificial Sequence: Synthetic peptide
  Seed: YKLVVVGAGDVGKS (KRAS G13D)
  Core: LVVVGAGDV
  misc_feature (3)..(3): Xaa can be Cys, Phe, His, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKS

SEQ ID NO: 27296 - protein, 14 aa, Artificial Sequence
  Description of Artificial Sequence: Synthetic peptide
  Seed: YKLVVVGAGDVGKS (KRAS G13D)
  Core: VGAGDVGKS
  misc_feature (6)..(6): Xaa can be Ala, Cys, Asp, Glu, Phe, His, Ile, Leu, Met, Pro, Gln, Thr, Val, Trp, or Tyr
  misc_feature (9)..(9): Xaa can be Ala, Cys, Phe, Gly, Ile, Met, Asn, Ser, Thr, Val, or Trp
  misc_feature (11)..(11): Xaa can be Ala, Cys, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Ser, Thr, Val, Trp, or Ty r
YKLVVXGAXDXGKX

SEQ ID NO: 27297 - protein, 15 aa, Artificial Sequence
  Description of Artificial Sequence: Synthetic peptide
  Seed: YKLVVVGAGDVGKSA (KRAS G13D)
  Core: LVVVGAGDV
  misc_feature (3)..(3): Xaa can be Ala, Cys, Phe, Gly, His, Ile, Lys, Leu, Met, Asn, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSA

SEQ ID NO: 27298 - protein, 15 aa, Artificial Sequence
  Description of Artificial Sequence: Synthetic peptide
  Seed: YKLVVVGAGDVGKSA (KRAS G13D)
  Core: VVVGAGDVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKLXVVXAXDVXKSA

SEQ ID NO: 27299 - protein, 15 aa, Artificial Sequence
  Description of Artificial Sequence: Synthetic peptide
  Seed: YKLVVVGAGDVGKSA (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Met, Asn, Gln, Ser, Thr, Val, Trp, or Tyr
  misc_feature (11)..(11): Xaa can be Ala, Cys, Asp, Glu, Phe, Gly, Ile, Leu, Met, Asn, Pro, Ser, Thr, or Val
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YKLVVXGAXDXGKXA

SEQ ID NO: 27300 - protein, 16 aa, Artificial Sequence
  Description of Artificial Sequence: Synthetic peptide
  Seed: YKLVVVGAGDVGKSAL (KRAS G13D)
  Core: LVVVGAGDV
  misc_feature (3)..(3): Xaa can be Ala, Cys, Phe, Ile, Leu, Met, Asn, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSAL

SEQ ID NO: 27301 - protein, 16 aa, Artificial Sequence
  Description of Artificial Sequence: Synthetic peptide
  Seed: YKLVVVGAGDVGKSAL (KRAS G13D)
  Core: VVVGAGDVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKLXVVXAXDVXKSAL

SEQ ID NO: 27302 - protein, 16 aa, Artificial Sequence
  Description of Artificial Sequence: Synthetic peptide
  Seed: YKLVVVGAGDVGKSAL (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Leu, Met, Asn, Gln, Ser, Thr, Val, Trp, or Tyr
  misc_feature (11)..(11): Xaa can be Ala, Cys, Asp, Glu, Phe, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
YKLVVXGAXDXGKXAL

SEQ ID NO: 27303 - protein, 17 aa, Artificial Sequence
  Description of Artificial Sequence: Synthetic peptide
  Seed: YKLVVVGAGDVGKSALT (KRAS G13D)
  Core: LVVVGAGDV
  misc_feature (3)..(3): Xaa can be Cys, Phe, Ile, Leu, Met, Asn, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSALT

SEQ ID NO: 27304 - protein, 17 aa, Artificial Sequence
  Description of Artificial Sequence: Synthetic peptide
  Seed: YKLVVVGAGDVGKSALT (KRAS G13D)
  Core: VVVGAGDVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKLXVVXAXDVXKSALT

SEQ ID NO: 27305 - protein, 17 aa, Artificial Sequence
  Description of Artificial Sequence: Synthetic peptide
  Seed: YKLVVVGAGDVGKSALT (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Ser, Thr, or Val
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
YKLVVXGAXDXGKXALT

SEQ ID NO: 27306 - protein, 18 aa, Artificial Sequence
  Description of Artificial Sequence: Synthetic peptide
  Seed: YKLVVVGAGDVGKSALTI (KRAS G13D)
  Core: LVVVGAGDV
  misc_feature (3)..(3): Xaa can be Phe, Ile, Leu, Met, Val, Trp, or Tyr
  misc_feature (6)..(6): Xaa can be Ala, Phe, His, Ile, Leu, Met, Asn, Ser, Val, Trp, or Tyr
  misc_feature (8)..(8): Xaa can be Ala, Asp, Phe, Gly, Ile, Leu, Met, Asn, Pro, Ser, Thr, or Val
  misc_feature (11)..(11): Xaa can be Ala, Asp, Glu, Phe, Gly, Ile, Leu, Met, Asn, Gln, Ser, Thr, Val, or Tyr
YKXVVXGXGDXGKSALTI

SEQ ID NO: 27307 - protein, 18 aa, Artificial Sequence
  Description of Artificial Sequence: Synthetic peptide
  Seed: YKLVVVGAGDVGKSALTI (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Phe, Gly, His, Ile, Leu, Met, Asn, Ser, Thr, Val, or Trp
  misc_feature (11)..(11): Xaa can be Ala, Cys, Phe, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Ser, Thr, Val, Trp, or Ty r
YKLVVXGAXDXGKXALTI

SEQ ID NO: 27308 - protein, 19 aa, Artificial Sequence
  Description of Artificial Sequence: Synthetic peptide
  Seed: YKLVVVGAGDVGKSALTIQ (KRAS G13D)
  Core: LVVVGAGDV
  misc_feature (3)..(3): Xaa can be Cys, Phe, Ile, Leu, Met, Asn, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSALTIQ

SEQ ID NO: 27309 - protein, 19 aa, Artificial Sequence
  Description of Artificial Sequence: Synthetic peptide
  Seed: YKLVVVGAGDVGKSALTIQ (KRAS G13D)
  Core: VVVGAGDVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKLXVVXAXDVXKSALTIQ

SEQ ID NO: 27310 - protein, 19 aa, Artificial Sequence
  Description of Artificial Sequence: Synthetic peptide
  Seed: YKLVVVGAGDVGKSALTIQ (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Asp, Phe, Gly, His, Ile, Leu, Met, Asn, Pro, Gln, Ser, Thr, Val, or Trp
  misc_feature (11)..(11): Xaa can be Ala, Cys, Asp, Glu, Phe, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
YKLVVXGAXDXGKXALTIQ

SEQ ID NO: 27311 - protein, 20 aa, Artificial Sequence
  Description of Artificial Sequence: Synthetic peptide
  Seed: YKLVVVGAGDVGKSALTIQL (KRAS G13D)
  Core: LVVVGAGDV
  misc_feature (3)..(3): Xaa can be Ala, Cys, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSALTIQL

SEQ ID NO: 27312 - protein, 20 aa, Artificial Sequence
  Description of Artificial Sequence: Synthetic peptide
  Seed: YKLVVVGAGDVGKSALTIQL (KRAS G13D)
  Core: VVVGAGDVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKLXVVXAXDVXKSALTIQL

SEQ ID NO: 27313 - protein, 20 aa, Artificial Sequence
  Description of Artificial Sequence: Synthetic peptide
  Seed: YKLVVVGAGDVGKSALTIQL (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, Ile, Leu, Met, Asn, Pro, Ser, Thr, Val, or Trp
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
YKLVVXGAXDXGKXALTIQL

SEQ ID NO: 27314 - protein, 21 aa, Artificial Sequence
  Description of Artificial Sequence: Synthetic peptide
  Seed: YKLVVVGAGDVGKSALTIQLI (KRAS G13D)
  Core: LVVVGAGDV
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSALTIQLI

SEQ ID NO: 27315 - protein, 21 aa, Artificial Sequence
  Description of Artificial Sequence: Synthetic peptide
  Seed: YKLVVVGAGDVGKSALTIQLI (KRAS G13D)
  Core: VVVGAGDVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, or Tr p
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKLXVVXAXDVXKSALTIQLI

SEQ ID NO: 27316 - protein, 21 aa, Artificial Sequence
  Description of Artificial Sequence: Synthetic peptide
  Seed: YKLVVVGAGDVGKSALTIQLI (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Phe, Gly, His, Ile, Leu, Met, Asn, Pro, Ser, Thr, Val, Trp, or Tyr
  misc_feature (11)..(11): Xaa can be Ala, Cys, Asp, Glu, Phe, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
YKLVVXGAXDXGKXALTIQLI

SEQ ID NO: 27317 - protein, 22 aa, Artificial Sequence
  Description of Artificial Sequence: Synthetic peptide
  Seed: YKLVVVGAGDVGKSALTIQLIQ (KRAS G13D)
  Core: LVVVGAGDV
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSALTIQLIQ

SEQ ID NO: 27318 - protein, 22 aa, Artificial Sequence
  Description of Artificial Sequence: Synthetic peptide
  Seed: YKLVVVGAGDVGKSALTIQLIQ (KRAS G13D)
  Core: VVVGAGDVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, or Tr p
  misc_feature (12)..(12): Xaa can be Ala, Cys, Asp, Glu, Gly, His, Ile, Lys, Leu, Met, Asn, Pro, Gln, Arg, Ser, Thr, or Val
YKLXVVXAXDVXKSALTIQLIQ

SEQ ID NO: 27319 - protein, 22 aa, Artificial Sequence
  Description of Artificial Sequence: Synthetic peptide
  Seed: YKLVVVGAGDVGKSALTIQLIQ (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Phe, Gly, His, Ile, Leu, Met, Asn, Pro, Ser, Thr, Val, Trp, or Tyr
  misc_feature (11)..(11): Xaa can be Ala, Cys, Asp, Glu, Phe, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
YKLVVXGAXDXGKXALTIQLIQ

SEQ ID NO: 27320 - protein, 23 aa, Artificial Sequence
  Description of Artificial Sequence: Synthetic peptide
  Seed: YKLVVVGAGDVGKSALTIQLIQN (KRAS G13D)
  Core: LVVVGAGDV
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSALTIQLIQN

SEQ ID NO: 27321 - protein, 23 aa, Artificial Sequence
  Description of Artificial Sequence: Synthetic peptide
  Seed: YKLVVVGAGDVGKSALTIQLIQN (KRAS G13D)
  Core: VVVGAGDVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, or Tr p
  misc_feature (12)..(12): Xaa can be Ala, Cys, Asp, Glu, Gly, His, Ile, Lys, Leu, Met, Asn, Pro, Gln, Arg, Ser, Thr, or Val
YKLXVVXAXDVXKSALTIQLIQN

SEQ ID NO: 27322 - protein, 23 aa, Artificial Sequence
  Description of Artificial Sequence: Synthetic peptide
  Seed: YKLVVVGAGDVGKSALTIQLIQN (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Asp, Phe, Gly, His, Ile, Leu, Met, Asn, Ser, Thr, Val, Trp, or Tyr
  misc_feature (11)..(11): Xaa can be Ala, Cys, Asp, Glu, Phe, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
YKLVVXGAXDXGKXALTIQLIQN

SEQ ID NO: 27323 - protein, 24 aa, Artificial Sequence
  Description of Artificial Sequence: Synthetic peptide
  Seed: YKLVVVGAGDVGKSALTIQLIQNH (KRAS G13D)
  Core: LVVVGAGDV
  misc_feature (3)..(3): Xaa can be Ala, Cys, Glu, Phe, His, Ile, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSALTIQLIQNH

SEQ ID NO: 27324 - protein, 24 aa, Artificial Sequence
  Description of Artificial Sequence: Synthetic peptide
  Seed: YKLVVVGAGDVGKSALTIQLIQNH (KRAS G13D)
  Core: VVVGAGDVG
  misc_feature (4)..(4): Xaa can be Ala, Cys, Asp, Glu, Phe, His, Ile, Leu, Met, Asn, Pro, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, or Val
  misc_feature (12)..(12): Xaa can be Ala, Cys, Asp, Glu, Gly, His, Ile, Lys, Leu, Met, Asn, Pro, Gln, Arg, Ser, Thr, or Val
YKLXVVXAXDVXKSALTIQLIQNH

SEQ ID NO: 27325 - protein, 24 aa, Artificial Sequence
  Description of Artificial Sequence: Synthetic peptide
  Seed: YKLVVVGAGDVGKSALTIQLIQNH (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Asp, Phe, Gly, His, Ile, Met, Asn, Ser, Thr, Val, or Trp
  misc_feature (11)..(11): Xaa can be Ala, Cys, Asp, Glu, Phe, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
YKLVVXGAXDXGKXALTIQLIQNH

SEQ ID NO: 27326 - protein, 25 aa, Artificial Sequence
  Description of Artificial Sequence: Synthetic peptide
  Seed: YKLVVVGAGDVGKSALTIQLIQNHF (KRAS G13D)
  Core: LVVVGAGDV
  misc_feature (3)..(3): Xaa can be Ala, Cys, Asp, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YKXVVXGXGDXGKSALTIQLIQNHF

SEQ ID NO: 27327 - protein, 25 aa, Artificial Sequence
  Description of Artificial Sequence: Synthetic peptide
  Seed: YKLVVVGAGDVGKSALTIQLIQNHF (KRAS G13D)
  Core: VVVGAGDVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKLXVVXAXDVXKSALTIQLIQNHF

SEQ ID NO: 27328 - protein, 25 aa, Artificial Sequence
  Description of Artificial Sequence: Synthetic peptide
  Seed: YKLVVVGAGDVGKSALTIQLIQNHF (KRAS G13D)
  Core: VGAGDVGKS
  misc_feature (6)..(6): Xaa can be Ala, Cys, Asp, Glu, Phe, His, Ile, Lys, Leu, Met, Asn, Pro, Gln, Ser, Thr, Val, Trp, or Ty r
  misc_feature (9)..(9): Xaa can be Ala, Cys, Asp, Phe, Gly, His, Ile, Met, Asn, Ser, Thr, Val, or Trp
  misc_feature (11)..(11): Xaa can be Ala, Cys, Asp, Glu, Phe, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Ser, Thr, Val, Trp, or Ty r
YKLVVXGAXDXGKXALTIQLIQNHF

SEQ ID NO: 27329 - protein, 20 aa, Artificial Sequence
  Description of Artificial Sequence: Synthetic peptide
  Seed: CLLDILDTAGKEEYSAMRDQ (NRAS Q61K)
  Core: ILDTAGKEE
  misc_feature (5)..(5): Xaa can be Ala, Cys, Glu, Phe, His, Ile, Lys, Leu, Met, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLLDXLDXAXKEXYSAMRDQ

SEQ ID NO: 27330 - protein, 22 aa, Artificial Sequence
  Description of Artificial Sequence: Synthetic peptide
  Seed: CLLDILDTAGKEEYSAMRDQYM (NRAS Q61K)
  Core: ILDTAGKEE
  misc_feature (5)..(5): Xaa can be Ala, Cys, Glu, Phe, His, Ile, Lys, Leu, Met, Gln, Arg, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLLDXLDXAXKEXYSAMRDQYM

SEQ ID NO: 27331 - protein, 19 aa, Artificial Sequence
  Description of Artificial Sequence: Synthetic peptide
  Seed: DGETCLLDILDTAGKEEYS (NRAS Q61K)
  Core: ILDTAGKEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXKEXYS

SEQ ID NO: 27332 - protein, 20 aa, Artificial Sequence
  Description of Artificial Sequence: Synthetic peptide
  Seed: DGETCLLDILDTAGKEEYSA (NRAS Q61K)
  Core: ILDTAGKEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXKEXYSA

SEQ ID NO: 27333 - protein, 21 aa, Artificial Sequence
  Description of Artificial Sequence: Synthetic peptide
  Seed: DGETCLLDILDTAGKEEYSAM (NRAS Q61K)
  Core: ILDTAGKEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXKEXYSAM

SEQ ID NO: 27334 - protein, 22 aa, Artificial Sequence
  Description of Artificial Sequence: Synthetic peptide
  Seed: DGETCLLDILDTAGKEEYSAMR (NRAS Q61K)
  Core: ILDTAGKEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXKEXYSAMR

SEQ ID NO: 27335 - protein, 23 aa, Artificial Sequence
  Description of Artificial Sequence: Synthetic peptide
  Seed: DGETCLLDILDTAGKEEYSAMRD (NRAS Q61K)
  Core: ILDTAGKEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXKEXYSAMRD

SEQ ID NO: 27336 - protein, 24 aa, Artificial Sequence
  Description of Artificial Sequence: Synthetic peptide
  Seed: DGETCLLDILDTAGKEEYSAMRDQ (NRAS Q61K)
  Core: ILDTAGKEE
  misc_feature (9)..(9): Xaa can be Ala, Cys, Asp, Glu, Phe, His, Ile, Lys, Leu, Met, Asn, Gln, Arg, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXKEXYSAMRDQ

SEQ ID NO: 27337 - protein, 25 aa, Artificial Sequence
  Description of Artificial Sequence: Synthetic peptide
  Seed: DGETCLLDILDTAGKEEYSAMRDQY (NRAS Q61K)
  Core: ILDTAGKEE
  misc_feature (9)..(9): Xaa can be Ala, Cys, Glu, Phe, His, Ile, Lys, Leu, Met, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXKEXYSAMRDQY

SEQ ID NO: 27338 - protein, 15 aa, Artificial Sequence
  Description of Artificial Sequence: Synthetic peptide
  Seed: ETCLLDILDTAGKEE (NRAS Q61K)
  Core: ILDTAGKEE
  misc_feature (7)..(7): Xaa can be Ala, Cys, Phe, Gly, His, Ile, Lys, Leu, Met, Gln, Arg, Ser, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXKEX

SEQ ID NO: 27339 - protein, 16 aa, Artificial Sequence
  Description of Artificial Sequence: Synthetic peptide
  Seed: ETCLLDILDTAGKEEY (NRAS Q61K)
  Core: ILDTAGKEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXKEXY

SEQ ID NO: 27340 - protein, 17 aa, Artificial Sequence
  Description of Artificial Sequence: Synthetic peptide
  Seed: ETCLLDILDTAGKEEYS (NRAS Q61K)
  Core: ILDTAGKEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXKEXYS

SEQ ID NO: 27341 - protein, 19 aa, Artificial Sequence
  Description of Artificial Sequence: Synthetic peptide
  Seed: ETCLLDILDTAGKEEYSAM (NRAS Q61K)
  Core: ILDTAGKEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXKEXYSAM

SEQ ID NO: 27342 - protein, 20 aa, Artificial Sequence
  Description of Artificial Sequence: Synthetic peptide
  Seed: ETCLLDILDTAGKEEYSAMR (NRAS Q61K)
  Core: ILDTAGKEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXKEXYSAMR

SEQ ID NO: 27343 - protein, 21 aa, Artificial Sequence
  Description of Artificial Sequence: Synthetic peptide
  Seed: ETCLLDILDTAGKEEYSAMRD (NRAS Q61K)
  Core: ILDTAGKEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXKEXYSAMRD

SEQ ID NO: 27344 - protein, 22 aa, Artificial Sequence
  Description of Artificial Sequence: Synthetic peptide
  Seed: ETCLLDILDTAGKEEYSAMRDQ (NRAS Q61K)
  Core: ILDTAGKEE
  misc_feature (7)..(7): Xaa can be Ala, Cys, Asp, Glu, Phe, His, Ile, Lys, Leu, Met, Gln, Arg, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXKEXYSAMRDQ

SEQ ID NO: 27345 - protein, 23 aa, Artificial Sequence
  Description of Artificial Sequence: Synthetic peptide
  Seed: ETCLLDILDTAGKEEYSAMRDQY (NRAS Q61K)
  Core: ILDTAGKEE
  misc_feature (7)..(7): Xaa can be Ala, Cys, Glu, Phe, His, Ile, Lys, Leu, Met, Gln, Arg, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXKEXYSAMRDQY

SEQ ID NO: 27346 - protein, 24 aa, Artificial Sequence
  Description of Artificial Sequence: Synthetic peptide
  Seed: ETCLLDILDTAGKEEYSAMRDQYM (NRAS Q61K)
  Core: ILDTAGKEE
  misc_feature (7)..(7): Xaa can be Ala, Cys, Glu, Phe, His, Ile, Lys, Leu, Met, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXKEXYSAMRDQYM

SEQ ID NO: 27347 - protein, 16 aa, Artificial Sequence
  Description of Artificial Sequence: Synthetic peptide
  Seed: GETCLLDILDTAGKEE (NRAS Q61K)
  Core: ILDTAGKEE
  misc_feature (8)..(8): Xaa can be Cys, Phe, Ile, Leu, Met, Arg, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXKEX

SEQ ID NO: 27348 - protein, 17 aa, Artificial Sequence
  Description of Artificial Sequence: Synthetic peptide
  Seed: GETCLLDILDTAGKEEY (NRAS Q61K)
  Core: ILDTAGKEE
  misc_feature (8)..(8): Xaa can be Ala, Cys, Glu, Phe, Gly, His, Ile, Lys, Leu, Met, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXKEXY

SEQ ID NO: 27349 - protein, 19 aa, Artificial Sequence
  Description of Artificial Sequence: Synthetic peptide
  Seed: GETCLLDILDTAGKEEYSA (NRAS Q61K)
  Core: ILDTAGKEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXKEXYSA

SEQ ID NO: 27350 - protein, 20 aa, Artificial Sequence
  Description of Artificial Sequence: Synthetic peptide
  Seed: GETCLLDILDTAGKEEYSAM (NRAS Q61K)
  Core: ILDTAGKEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXKEXYSAM

SEQ ID NO: 27351 - protein, 21 aa, Artificial Sequence
  Description of Artificial Sequence: Synthetic peptide
  Seed: GETCLLDILDTAGKEEYSAMR (NRAS Q61K)
  Core: ILDTAGKEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXKEXYSAMR

SEQ ID NO: 27352 - protein, 22 aa, Artificial Sequence
  Description of Artificial Sequence: Synthetic peptide
  Seed: GETCLLDILDTAGKEEYSAMRD (NRAS Q61K)
  Core: ILDTAGKEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXKEXYSAMRD

SEQ ID NO: 27353 - protein, 23 aa, Artificial Sequence
  Description of Artificial Sequence: Synthetic peptide
  Seed: GETCLLDILDTAGKEEYSAMRDQ (NRAS Q61K)
  Core: ILDTAGKEE
  misc_feature (8)..(8): Xaa can be Ala, Cys, Asp, Glu, Phe, His, Ile, Lys, Leu, Met, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXKEXYSAMRDQ

SEQ ID NO: 27354 - protein, 24 aa, Artificial Sequence
  Description of Artificial Sequence: Synthetic peptide
  Seed: GETCLLDILDTAGKEEYSAMRDQY (NRAS Q61K)
  Core: ILDTAGKEE
  misc_feature (8)..(8): Xaa can be Ala, Cys, Glu, Phe, His, Ile, Lys, Leu, Met, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXKEXYSAMRDQY

SEQ ID NO: 27355 - protein, 25 aa, Artificial Sequence
  Description of Artificial Sequence: Synthetic peptide
  Seed: GETCLLDILDTAGKEEYSAMRDQYM (NRAS Q61K)
  Core: ILDTAGKEE
  misc_feature (8)..(8): Xaa can be Ala, Cys, Asp, Glu, Phe, His, Ile, Lys, Leu, Met, Pro, Gln, Arg, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXKEXYSAMRDQYM

SEQ ID NO: 27356 - protein, 25 aa, Artificial Sequence
  Description of Artificial Sequence: Synthetic peptide
  Seed: GETCLLDILDTAGKEEYSAMRDQYM (NRAS Q61K)
  Core: AGKEEYSAM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDILDTXGKXEXSAXRDQYM

SEQ ID NO: 27357 - protein, 19 aa, Artificial Sequence
  Description of Artificial Sequence: Synthetic peptide
  Seed: IDGETCLLDILDTAGKEEY (NRAS Q61K)
  Core: ILDTAGKEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXKEXY

SEQ ID NO: 27358 - protein, 20 aa, Artificial Sequence
  Description of Artificial Sequence: Synthetic peptide
  Seed: IDGETCLLDILDTAGKEEYS (NRAS Q61K)
  Core: ILDTAGKEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXKEXYS

SEQ ID NO: 27359 - protein, 21 aa, Artificial Sequence
  Description of Artificial Sequence: Synthetic peptide
  Seed: IDGETCLLDILDTAGKEEYSA (NRAS Q61K)
  Core: ILDTAGKEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXKEXYSA

SEQ ID NO: 27360 - protein, 22 aa, Artificial Sequence
  Description of Artificial Sequence: Synthetic peptide
  Seed: IDGETCLLDILDTAGKEEYSAM (NRAS Q61K)
  Core: ILDTAGKEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXKEXYSAM

SEQ ID NO: 27361 - protein, 23 aa, Artificial Sequence
  Description of Artificial Sequence: Synthetic peptide
  Seed: IDGETCLLDILDTAGKEEYSAMR (NRAS Q61K)
  Core: ILDTAGKEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXKEXYSAMR

SEQ ID NO: 27362 - protein, 24 aa, Artificial Sequence
  Description of Artificial Sequence: Synthetic peptide
  Seed: IDGETCLLDILDTAGKEEYSAMRD (NRAS Q61K)
  Core: ILDTAGKEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXKEXYSAMRD

SEQ ID NO: 27363 - protein, 25 aa, Artificial Sequence
  Description of Artificial Sequence: Synthetic peptide
  Seed: IDGETCLLDILDTAGKEEYSAMRDQ (NRAS Q61K)
  Core: ILDTAGKEE
  misc_feature (10)..(10): Xaa can be Ala, Cys, Asp, Glu, Phe, His, Ile, Lys, Leu, Met, Asn, Gln, Arg, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXKEXYSAMRDQ

SEQ ID NO: 27364 - protein, 24 aa, Artificial Sequence
  Description of Artificial Sequence: Synthetic peptide
  Seed: KQVVIDGETCLLDILDTAGKEEYS (NRAS Q61K)
  Core: ILDTAGKEE
  misc_feature (14)..(14): Xaa can be Ala, Cys, Glu, Phe, His, Ile, Lys, Leu, Met, Gln, Arg, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KQVVIDGETCLLDXLDXAXKEXYS

SEQ ID NO: 27365 - protein, 25 aa, Artificial Sequence
  Description of Artificial Sequence: Synthetic peptide
  Seed: KQVVIDGETCLLDILDTAGKEEYSA (NRAS Q61K)
  Core: ILDTAGKEE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KQVVIDGETCLLDXLDXAXKEXYSA

SEQ ID NO: 27366 - protein, 20 aa, Artificial Sequence
  Description of Artificial Sequence: Synthetic peptide
  Seed: LDILDTAGKEEYSAMRDQYM (NRAS Q61K)
  Core: DTAGKEEYS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDILXTAXKXEYXAMRDQYM

SEQ ID NO: 27367 - protein, 15 aa, Artificial Sequence
  Description of Artificial Sequence: Synthetic peptide
  Seed: LLDILDTAGKEEYSA (NRAS Q61K)
  Core: ILDTAGKEE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXKEXYSA

SEQ ID NO: 27368 - protein, 16 aa, Artificial Sequence
  Description of Artificial Sequence: Synthetic peptide
  Seed: LLDILDTAGKEEYSAM (NRAS Q61K)
  Core: ILDTAGKEE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXKEXYSAM

SEQ ID NO: 27369 - protein, 20 aa, Artificial Sequence
  Description of Artificial Sequence: Synthetic peptide
  Seed: LLDILDTAGKEEYSAMRDQY (NRAS Q61K)
  Core: ILDTAGKEE
  misc_feature (4)..(4): Xaa can be Ala, Phe, His, Ile, Lys, Leu, Met, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXKEXYSAMRDQY

SEQ ID NO: 27370 - protein, 21 aa, Artificial Sequence
  Description of Artificial Sequence: Synthetic peptide
  Seed: LLDILDTAGKEEYSAMRDQYM (NRAS Q61K)
  Core: ILDTAGKEE
  misc_feature (4)..(4): Xaa can be Glu, Phe, His, Ile, Lys, Leu, Met, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXKEXYSAMRDQYM

SEQ ID NO: 27371 - protein, 22 aa, Artificial Sequence
  Description of Artificial Sequence: Synthetic peptide
  Seed: QVVIDGETCLLDILDTAGKEEY (NRAS Q61K)
  Core: ILDTAGKEE
  misc_feature (13)..(13): Xaa can be Cys, Phe, His, Ile, Leu, Met, Gln, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Leu, Met, Asn, Pro, Gln, Ser, Thr, Val, Trp, or Ty r
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXKEXY

SEQ ID NO: 27372 - protein, 23 aa, Artificial Sequence
  Description of Artificial Sequence: Synthetic peptide
  Seed: QVVIDGETCLLDILDTAGKEEYS (NRAS Q61K)
  Core: ILDTAGKEE
  misc_feature (13)..(13): Xaa can be Ala, Cys, Asp, Glu, Phe, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXKEXYS

SEQ ID NO: 27373 - protein, 24 aa, Artificial Sequence
  Description of Artificial Sequence: Synthetic peptide
  Seed: QVVIDGETCLLDILDTAGKEEYSA (NRAS Q61K)
  Core: ILDTAGKEE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXKEXYSA

SEQ ID NO: 27374 - protein, 25 aa, Artificial Sequence
  Description of Artificial Sequence: Synthetic peptide
  Seed: QVVIDGETCLLDILDTAGKEEYSAM (NRAS Q61K)
  Core: ILDTAGKEE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXKEXYSAM

SEQ ID NO: 27375 - protein, 25 aa, Artificial Sequence
  Description of Artificial Sequence: Synthetic peptide
  Seed: RKQVVIDGETCLLDILDTAGKEEYS (NRAS Q61K)
  Core: ILDTAGKEE
  misc_feature (15)..(15): Xaa can be Ala, Cys, Glu, Phe, His, Ile, Leu, Met, Gln, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RKQVVIDGETCLLDXLDXAXKEXYS

SEQ ID NO: 27376 - protein, 15 aa, Artificial Sequence
  Description of Artificial Sequence: Synthetic peptide
  Seed: TCLLDILDTAGKEEY (NRAS Q61K)
  Core: ILDTAGKEE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXKEXY

SEQ ID NO: 27377 - protein, 16 aa, Artificial Sequence
  Description of Artificial Sequence: Synthetic peptide
  Seed: TCLLDILDTAGKEEYS (NRAS Q61K)
  Core: ILDTAGKEE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXKEXYS

SEQ ID NO: 27378 - protein, 17 aa, Artificial Sequence
  Description of Artificial Sequence: Synthetic peptide
  Seed: TCLLDILDTAGKEEYSA (NRAS Q61K)
  Core: ILDTAGKEE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXKEXYSA

SEQ ID NO: 27379 - protein, 19 aa, Artificial Sequence
  Description of Artificial Sequence: Synthetic peptide
  Seed: TCLLDILDTAGKEEYSAMR (NRAS Q61K)
  Core: ILDTAGKEE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXKEXYSAMR

SEQ ID NO: 27380 - protein, 20 aa, Artificial Sequence
  Description of Artificial Sequence: Synthetic peptide
  Seed: TCLLDILDTAGKEEYSAMRD (NRAS Q61K)
  Core: ILDTAGKEE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXKEXYSAMRD

SEQ ID NO: 27381 - protein, 23 aa, Artificial Sequence
  Description of Artificial Sequence: Synthetic peptide
  Seed: TCLLDILDTAGKEEYSAMRDQYM (NRAS Q61K)
  Core: ILDTAGKEE
  misc_feature (6)..(6): Xaa can be Ala, Cys, Glu, Phe, His, Ile, Lys, Leu, Met, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXKEXYSAMRDQYM

SEQ ID NO: 27382 - protein, 19 aa, Artificial Sequence
  Description of Artificial Sequence: Synthetic peptide
  Seed: VIDGETCLLDILDTAGKEE (NRAS Q61K)
  Core: ILDTAGKEE
  misc_feature (11)..(11): Xaa can be Cys, Phe, His, Ile, Leu, Met, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Glu, Phe, His, Ile, Lys, Leu, Met, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXKEX

SEQ ID NO: 27383 - protein, 20 aa, Artificial Sequence
  Description of Artificial Sequence: Synthetic peptide
  Seed: VIDGETCLLDILDTAGKEEY (NRAS Q61K)
  Core: ILDTAGKEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXKEXY

SEQ ID NO: 27384 - protein, 21 aa, Artificial Sequence
  Description of Artificial Sequence: Synthetic peptide
  Seed: VIDGETCLLDILDTAGKEEYS (NRAS Q61K)
  Core: ILDTAGKEE
  misc_feature (11)..(11): Xaa can be Ala, Cys, Asp, Glu, Phe, Gly, His, Ile, Lys, Leu, Met, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXKEXYS

SEQ ID NO: 27385 - protein, 22 aa, Artificial Sequence
  Description of Artificial Sequence: Synthetic peptide
  Seed: VIDGETCLLDILDTAGKEEYSA (NRAS Q61K)
  Core: ILDTAGKEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXKEXYSA

SEQ ID NO: 27386 - protein, 23 aa, Artificial Sequence
  Description of Artificial Sequence: Synthetic peptide
  Seed: VIDGETCLLDILDTAGKEEYSAM (NRAS Q61K)
  Core: ILDTAGKEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXKEXYSAM

SEQ ID NO: 27387 - protein, 24 aa, Artificial Sequence
  Description of Artificial Sequence: Synthetic peptide
  Seed: VIDGETCLLDILDTAGKEEYSAMR (NRAS Q61K)
  Core: ILDTAGKEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXKEXYSAMR

SEQ ID NO: 27388 - protein, 25 aa, Artificial Sequence
  Description of Artificial Sequence: Synthetic peptide
  Seed: VIDGETCLLDILDTAGKEEYSAMRD (NRAS Q61K)
  Core: ILDTAGKEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXKEXYSAMRD

SEQ ID NO: 27389 - protein, 25 aa, Artificial Sequence
  Description of Artificial Sequence: Synthetic peptide
  Seed: VIDGETCLLDILDTAGKEEYSAMRD (NRAS Q61K)
  Core: AGKEEYSAM
  misc_feature (15)..(15): Xaa can be Ala, Cys, Phe, Ile, Leu, Met, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDILDTXGKXEXSAXRD

SEQ ID NO: 27390 - protein, 20 aa, Artificial Sequence
  Description of Artificial Sequence: Synthetic peptide
  Seed: VVIDGETCLLDILDTAGKEE (NRAS Q61K)
  Core: ILDTAGKEE
  misc_feature (12)..(12): Xaa can be Cys, Phe, Ile, Leu, Met, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Leu, Met, Asn, Pro, Gln, Ser, Thr, Val, Trp, or Ty r
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXKEX

SEQ ID NO: 27391 - protein, 21 aa, Artificial Sequence
  Description of Artificial Sequence: Synthetic peptide
  Seed: VVIDGETCLLDILDTAGKEEY (NRAS Q61K)
  Core: ILDTAGKEE
  misc_feature (12)..(12): Xaa can be Ala, Cys, Glu, Phe, His, Ile, Lys, Leu, Met, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXKEXY

SEQ ID NO: 27392 - protein, 22 aa, Artificial Sequence
  Description of Artificial Sequence: Synthetic peptide
  Seed: VVIDGETCLLDILDTAGKEEYS (NRAS Q61K)
  Core: ILDTAGKEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXKEXYS

SEQ ID NO: 27393 - protein, 23 aa, Artificial Sequence
  Description of Artificial Sequence: Synthetic peptide
  Seed: VVIDGETCLLDILDTAGKEEYSA (NRAS Q61K)
  Core: ILDTAGKEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXKEXYSA

SEQ ID NO: 27394 - protein, 24 aa, Artificial Sequence
  Description of Artificial Sequence: Synthetic peptide
  Seed: VVIDGETCLLDILDTAGKEEYSAM (NRAS Q61K)
  Core: ILDTAGKEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXKEXYSAM

SEQ ID NO: 27395 - protein, 25 aa, Artificial Sequence
  Description of Artificial Sequence: Synthetic peptide
  Seed: VVIDGETCLLDILDTAGKEEYSAMR (NRAS Q61K)
  Core: ILDTAGKEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXKEXYSAMR

SEQ ID NO: 27396 - protein, 25 aa, Artificial Sequence
  Description of Artificial Sequence: Synthetic peptide
  Seed: VVIDGETCLLDILDTAGKEEYSAMR (NRAS Q61K)
  Core: AGKEEYSAM
  misc_feature (16)..(16): Xaa can be Ala, Phe, Ile, Leu, Met, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Phe, Gly, His, Ile, Leu, Met, Asn, Pro, Gln, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDILDTXGKXEXSAXR

SEQ ID NO: 27397 - protein, 14 aa, Artificial Sequence
  Description of Artificial Sequence: Synthetic peptide
  Seed: CLLDILDTAGLEEY (NRAS Q61L)
  Core: ILDTAGLEE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLLDXLDXAXLEXY

SEQ ID NO: 27398 - protein, 15 aa, Artificial Sequence
  Description of Artificial Sequence: Synthetic peptide
  Seed: CLLDILDTAGLEEYS (NRAS Q61L)
  Core: ILDTAGLEE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLLDXLDXAXLEXYS

SEQ ID NO: 27399 - protein, 16 aa, Artificial Sequence
  Description of Artificial Sequence: Synthetic peptide
  Seed: CLLDILDTAGLEEYSA (NRAS Q61L)
  Core: ILDTAGLEE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLLDXLDXAXLEXYSA

SEQ ID NO: 27400 - protein, 17 aa, Artificial Sequence
  Description of Artificial Sequence: Synthetic peptide
  Seed: CLLDILDTAGLEEYSAM (NRAS Q61L)
  Core: DTAGLEEYS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Phe, Gly, His, Ile, Leu, Met, Asn, Pro, Ser, Thr, Val, or Trp
  misc_feature (12)..(12): Xaa can be Ala, Cys, Asp, Glu, Gly, Ile, Leu, Met, Asn, Pro, Gln, Ser, Thr, or Val
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLLDILXTAXLXEYXAM

SEQ ID NO: 27401 - protein, 18 aa, Artificial Sequence
  Description of Artificial Sequence: Synthetic peptide
  Seed: CLLDILDTAGLEEYSAMR (NRAS Q61L)
  Core: DTAGLEEYS
  misc_feature (7)..(7): Xaa can be Ala, Cys, Asp, Glu, Phe, Gly, His, Ile, Leu, Met, Asn, Pro, Gln, Arg, Ser, Thr, Val, Trp, or Tyr
  misc_feature (10)..(10): Xaa can be Ala, Asp, Glu, Phe, Gly, His, Ile, Leu, Met, Asn, Pro, Gln, Ser, Thr, Val, Trp, or Tyr
  misc_feature (12)..(12): Xaa can be Ala, Asp, Glu, Gly, Ile, Leu, Met, Asn, Pro, Gln, Ser, Thr, or Val
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLLDILXTAXLXEYXAMR

SEQ ID NO: 27402 - protein, 19 aa, Artificial Sequence
  Description of Artificial Sequence: Synthetic peptide
  Seed: CLLDILDTAGLEEYSAMRD (NRAS Q61L)
  Core: DTAGLEEYS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Phe, Gly, Ile, Met, Asn, Pro, Ser, Thr, Val, or Trp
  misc_feature (12)..(12): Xaa can be Ala, Cys, Asp, Glu, Gly, Ile, Leu, Met, Asn, Pro, Gln, Ser, Thr, or Val
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLLDILXTAXLXEYXAMRD

SEQ ID NO: 27403 - protein, 20 aa, Artificial Sequence
  Description of Artificial Sequence: Synthetic peptide
  Seed: CLLDILDTAGLEEYSAMRDQ (NRAS Q61L)
  Core: DTAGLEEYS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
CLLDILXTAXLXEYXAMRDQ

SEQ ID NO: 27404 - protein, 21 aa, Artificial Sequence
  Description of Artificial Sequence: Synthetic peptide
  Seed: CLLDILDTAGLEEYSAMRDQY (NRAS Q61L)
  Core: AGLEEYSAM
  misc_feature (9)..(9): Xaa can be Ala, Cys, Asp, Glu, Phe, His, Ile, Lys, Leu, Met, Pro, Gln, Arg, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CLLDILDTXGLXEXSAXRDQY

SEQ ID NO: 27405 - protein, 17 aa, Artificial Sequence
  Description of Artificial Sequence: Synthetic peptide
  Seed: DGETCLLDILDTAGLEE (NRAS Q61L)
  Core: ILDTAGLEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXLEX

SEQ ID NO: 27406 - protein, 18 aa, Artificial Sequence
  Description of Artificial Sequence: Synthetic peptide
  Seed: DGETCLLDILDTAGLEEY (NRAS Q61L)
  Core: ILDTAGLEE
  misc_feature (9)..(9): Xaa can be Ala, Cys, Asp, Glu, Phe, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXLEXY

SEQ ID NO: 27407 - protein, 19 aa, Artificial Sequence
  Description of Artificial Sequence: Synthetic peptide
  Seed: DGETCLLDILDTAGLEEYS (NRAS Q61L)
  Core: ILDTAGLEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXLEXYS

SEQ ID NO: 27408 - protein, 20 aa, Artificial Sequence
  Description of Artificial Sequence: Synthetic peptide
  Seed: DGETCLLDILDTAGLEEYSA (NRAS Q61L)
  Core: ILDTAGLEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXLEXYSA

SEQ ID NO: 27409 - protein, 21 aa, Artificial Sequence
  Description of Artificial Sequence: Synthetic peptide
  Seed: DGETCLLDILDTAGLEEYSAM (NRAS Q61L)
  Core: ILDTAGLEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXLEXYSAM

SEQ ID NO: 27410 - protein, 22 aa, Artificial Sequence
  Description of Artificial Sequence: Synthetic peptide
  Seed: DGETCLLDILDTAGLEEYSAMR (NRAS Q61L)
  Core: ILDTAGLEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXLEXYSAMR

SEQ ID NO: 27411 - protein, 22 aa, Artificial Sequence
  Description of Artificial Sequence: Synthetic peptide
  Seed: DGETCLLDILDTAGLEEYSAMR (NRAS Q61L)
  Core: DTAGLEEYS
  misc_feature (11)..(11): Xaa can be Ala, Asp, Glu, Phe, Gly, His, Ile, Leu, Met, Asn, Pro, Gln, Arg, Ser, Thr, Val, Trp, or Ty r
  misc_feature (14)..(14): Xaa can be Ala, Asp, Glu, Phe, Gly, His, Ile, Met, Asn, Pro, Gln, Ser, Thr, or Val
  misc_feature (16)..(16): Xaa can be Ala, Asp, Glu, Ile, Pro, Thr, or Val
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDILXTAXLXEYXAMR

SEQ ID NO: 27412 - protein, 23 aa, Artificial Sequence
  Description of Artificial Sequence: Synthetic peptide
  Seed: DGETCLLDILDTAGLEEYSAMRD (NRAS Q61L)
  Core: AGLEEYSAM
  misc_feature (13)..(13): Xaa can be Ala, Cys, Asp, Glu, Phe, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDILDTXGLXEXSAXRD

SEQ ID NO: 27413 - protein, 24 aa, Artificial Sequence
  Description of Artificial Sequence: Synthetic peptide
  Seed: DGETCLLDILDTAGLEEYSAMRDQ (NRAS Q61L)
  Core: AGLEEYSAM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDILDTXGLXEXSAXRDQ

SEQ ID NO: 27414 - protein, 14 aa, Artificial Sequence
  Description of Artificial Sequence: Synthetic peptide
  Seed: DILDTAGLEEYSAM (NRAS Q61L)
  Core: DTAGLEEYS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Leu, Met, Asn, Pro, Gln, Ser, Thr, Val, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DILXTAXLXEYXAM

SEQ ID NO: 27415 - protein, 15 aa, Artificial Sequence
  Description of Artificial Sequence: Synthetic peptide
  Seed: DILDTAGLEEYSAMR (NRAS Q61L)
  Core: DTAGLEEYS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DILXTAXLXEYXAMR

SEQ ID NO: 27416 - protein, 16 aa, Artificial Sequence
  Description of Artificial Sequence: Synthetic peptide
  Seed: DILDTAGLEEYSAMRD (NRAS Q61L)
  Core: DTAGLEEYS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DILXTAXLXEYXAMRD

SEQ ID NO: 27417 - protein, 17 aa, Artificial Sequence
  Description of Artificial Sequence: Synthetic peptide
  Seed: DILDTAGLEEYSAMRDQ (NRAS Q61L)
  Core: DTAGLEEYS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Phe, Gly, His, Ile, Leu, Met, Asn, Pro, Ser, Thr, Val, Trp, or Tyr
  misc_feature (9)..(9): Xaa can be Ala, Cys, Asp, Glu, Phe, Gly, Ile, Leu, Met, Asn, Pro, Gln, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DILXTAXLXEYXAMRDQ

SEQ ID NO: 27418 - protein, 15 aa, Artificial Sequence
  Description of Artificial Sequence: Synthetic peptide
  Seed: ETCLLDILDTAGLEE (NRAS Q61L)
  Core: ILDTAGLEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXLEX

SEQ ID NO: 27419 - protein, 16 aa, Artificial Sequence
  Description of Artificial Sequence: Synthetic peptide
  Seed: ETCLLDILDTAGLEEY (NRAS Q61L)
  Core: ILDTAGLEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXLEXY

SEQ ID NO: 27420 - protein, 17 aa, Artificial Sequence
  Description of Artificial Sequence: Synthetic peptide
  Seed: ETCLLDILDTAGLEEYS (NRAS Q61L)
  Core: ILDTAGLEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXLEXYS

SEQ ID NO: 27421 - protein, 18 aa, Artificial Sequence
  Description of Artificial Sequence: Synthetic peptide
  Seed: ETCLLDILDTAGLEEYSA (NRAS Q61L)
  Core: ILDTAGLEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXLEXYSA

SEQ ID NO: 27422 - protein, 20 aa, Artificial Sequence
  Description of Artificial Sequence: Synthetic peptide
  Seed: ETCLLDILDTAGLEEYSAMR (NRAS Q61L)
  Core: ILDTAGLEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXLEXYSAMR

SEQ ID NO: 27423 - protein, 20 aa, Artificial Sequence
  Description of Artificial Sequence: Synthetic peptide
  Seed: ETCLLDILDTAGLEEYSAMR (NRAS Q61L)
  Core: DTAGLEEYS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Ser, Thr, Val, Trp, or Ty r
  misc_feature (14)..(14): Xaa can be Ala, Cys, Asp, Glu, Gly, Ile, Leu, Met, Asn, Pro, Gln, Ser, Thr, or Val
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDILXTAXLXEYXAMR

SEQ ID NO: 27424 - protein, 21 aa, Artificial Sequence
  Description of Artificial Sequence: Synthetic peptide
  Seed: ETCLLDILDTAGLEEYSAMRD (NRAS Q61L)
  Core: AGLEEYSAM
  misc_feature (11)..(11): Xaa can be Ala, Cys, Asp, Glu, Phe, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDILDTXGLXEXSAXRD

SEQ ID NO: 27425 - protein, 22 aa, Artificial Sequence
  Description of Artificial Sequence: Synthetic peptide
  Seed: ETCLLDILDTAGLEEYSAMRDQ (NRAS Q61L)
  Core: AGLEEYSAM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDILDTXGLXEXSAXRDQ

SEQ ID NO: 27426 - protein, 23 aa, Artificial Sequence
  Description of Artificial Sequence: Synthetic peptide
  Seed: ETCLLDILDTAGLEEYSAMRDQY (NRAS Q61L)
  Core: AGLEEYSAM
  misc_feature (11)..(11): Xaa can be Ala, Cys, Asp, Glu, Phe, His, Ile, Lys, Leu, Met, Pro, Gln, Arg, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDILDTXGLXEXSAXRDQY

SEQ ID NO: 27427 - protein, 24 aa, Artificial Sequence
  Description of Artificial Sequence: Synthetic peptide
  Seed: ETCLLDILDTAGLEEYSAMRDQYM (NRAS Q61L)
  Core: DTAGLEEYS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDILXTAXLXEYXAMRDQYM

SEQ ID NO: 27428 - protein, 16 aa, Artificial Sequence
  Description of Artificial Sequence: Synthetic peptide
  Seed: GETCLLDILDTAGLEE (NRAS Q61L)
  Core: ILDTAGLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXLEX

SEQ ID NO: 27429 - protein, 17 aa, Artificial Sequence
  Description of Artificial Sequence: Synthetic peptide
  Seed: GETCLLDILDTAGLEEY (NRAS Q61L)
  Core: ILDTAGLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXLEXY

SEQ ID NO: 27430 - protein, 18 aa, Artificial Sequence
  Description of Artificial Sequence: Synthetic peptide
  Seed: GETCLLDILDTAGLEEYS (NRAS Q61L)
  Core: ILDTAGLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXLEXYS

SEQ ID NO: 27431 - protein, 19 aa, Artificial Sequence
  Description of Artificial Sequence: Synthetic peptide
  Seed: GETCLLDILDTAGLEEYSA (NRAS Q61L)
  Core: ILDTAGLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXLEXYSA

SEQ ID NO: 27432 - protein, 20 aa, Artificial Sequence
  Description of Artificial Sequence: Synthetic peptide
  Seed: GETCLLDILDTAGLEEYSAM (NRAS Q61L)
  Core: ILDTAGLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXLEXYSAM

SEQ ID NO: 27433 - protein, 21 aa, Artificial Sequence
  Description of Artificial Sequence: Synthetic peptide
  Seed: GETCLLDILDTAGLEEYSAMR (NRAS Q61L)
  Core: ILDTAGLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXLEXYSAMR

SEQ ID NO: 27434 - protein, 21 aa, Artificial Sequence
  Description of Artificial Sequence: Synthetic peptide
  Seed: GETCLLDILDTAGLEEYSAMR (NRAS Q61L)
  Core: DTAGLEEYS
  misc_feature (10)..(10): Xaa can be Ala, Asp, Glu, Phe, Gly, His, Ile, Leu, Met, Asn, Pro, Gln, Ser, Thr, Val, Trp, or Tyr
  misc_feature (13)..(13): Xaa can be Ala, Asp, Glu, Gly, Ile, Met, Asn, Pro, Ser, Thr, or Val
  misc_feature (15)..(15): Xaa can be Ala, Asp, Glu, Ile, Pro, or Val
  misc_feature (18)..(18): Xaa can be Ala, Asp, Glu, Phe, Gly, His, Ile, Lys, Leu, Met, Asn, Pro, Gln, Arg, Ser, Thr, Val, Trp, or Tyr
GETCLLDILXTAXLXEYXAMR

SEQ ID NO: 27435 - protein, 22 aa, Artificial Sequence
  Description of Artificial Sequence: Synthetic peptide
  Seed: GETCLLDILDTAGLEEYSAMRD (NRAS Q61L)
  Core: AGLEEYSAM
  misc_feature (12)..(12): Xaa can be Ala, Cys, Asp, Glu, Phe, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDILDTXGLXEXSAXRD

SEQ ID NO: 27436 - protein, 23 aa, Artificial Sequence
  Description of Artificial Sequence: Synthetic peptide
  Seed: GETCLLDILDTAGLEEYSAMRDQ (NRAS Q61L)
  Core: AGLEEYSAM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDILDTXGLXEXSAXRDQ

SEQ ID NO: 27437 - protein, 25 aa, Artificial Sequence
  Description of Artificial Sequence: Synthetic peptide
  Seed: GETCLLDILDTAGLEEYSAMRDQYM (NRAS Q61L)
  Core: DTAGLEEYS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDILXTAXLXEYXAMRDQYM

SEQ ID NO: 27438 - protein, 18 aa, Artificial Sequence
  Description of Artificial Sequence: Synthetic peptide
  Seed: IDGETCLLDILDTAGLEE (NRAS Q61L)
  Core: ILDTAGLEE
  misc_feature (10)..(10): Xaa can be Cys, Asp, Glu, Phe, His, Ile, Lys, Leu, Met, Gln, Arg, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXLEX

SEQ ID NO: 27439 - protein, 19 aa, Artificial Sequence
  Description of Artificial Sequence: Synthetic peptide
  Seed: IDGETCLLDILDTAGLEEY (NRAS Q61L)
  Core: ILDTAGLEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXLEXY

SEQ ID NO: 27440 - protein, 20 aa, Artificial Sequence
  Description of Artificial Sequence: Synthetic peptide
  Seed: IDGETCLLDILDTAGLEEYS (NRAS Q61L)
  Core: ILDTAGLEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXLEXYS

SEQ ID NO: 27441 - protein, 21 aa, Artificial Sequence
  Description of Artificial Sequence: Synthetic peptide
  Seed: IDGETCLLDILDTAGLEEYSA (NRAS Q61L)
  Core: ILDTAGLEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXLEXYSA

SEQ ID NO: 27442 - protein, 22 aa, Artificial Sequence
  Description of Artificial Sequence: Synthetic peptide
  Seed: IDGETCLLDILDTAGLEEYSAM (NRAS Q61L)
  Core: ILDTAGLEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXLEXYSAM

SEQ ID NO: 27443 - protein, 23 aa, Artificial Sequence
  Description of Artificial Sequence: Synthetic peptide
  Seed: IDGETCLLDILDTAGLEEYSAMR (NRAS Q61L)
  Core: ILDTAGLEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXLEXYSAMR

SEQ ID NO: 27444 - protein, 23 aa, Artificial Sequence
  Description of Artificial Sequence: Synthetic peptide
  Seed: IDGETCLLDILDTAGLEEYSAMR (NRAS Q61L)
  Core: DTAGLEEYS
  misc_feature (12)..(12): Xaa can be Ala, Asp, Glu, Phe, Gly, His, Ile, Leu, Met, Asn, Pro, Gln, Arg, Ser, Thr, Val, Trp, or Ty r
  misc_feature (15)..(15): Xaa can be Ala, Asp, Glu, Phe, Gly, His, Ile, Met, Asn, Pro, Gln, Ser, Thr, Val, or Trp
  misc_feature (17)..(17): Xaa can be Ala, Asp, Glu, Ile, Pro, Thr, or Val
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDILXTAXLXEYXAMR

SEQ ID NO: 27445 - protein, 24 aa, Artificial Sequence
  Description of Artificial Sequence: Synthetic peptide
  Seed: IDGETCLLDILDTAGLEEYSAMRD (NRAS Q61L)
  Core: ILDTAGLEE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXLEXYSAMRD

SEQ ID NO: 27446 - protein, 25 aa, Artificial Sequence
  Description of Artificial Sequence: Synthetic peptide
  Seed: IDGETCLLDILDTAGLEEYSAMRDQ (NRAS Q61L)
  Core: AGLEEYSAM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDILDTXGLXEXSAXRDQ

SEQ ID NO: 27447 - protein, 15 aa, Artificial Sequence
  Description of Artificial Sequence: Synthetic peptide
  Seed: ILDTAGLEEYSAMRD (NRAS Q61L)
  Core: AGLEEYSAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ILDTXGLXEXSAXRD

SEQ ID NO: 27448 - protein, 16 aa, Artificial Sequence
  Description of Artificial Sequence: Synthetic peptide
  Seed: ILDTAGLEEYSAMRDQ (NRAS Q61L)
  Core: DTAGLEEYS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Leu, Met, Asn, Pro, Ser, Thr, Val, or Trp
  misc_feature (8)..(8): Xaa can be Ala, Cys, Asp, Glu, Phe, Gly, Ile, Leu, Met, Asn, Pro, Gln, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXTAXLXEYXAMRDQ

SEQ ID NO: 27449 - protein, 16 aa, Artificial Sequence
  Description of Artificial Sequence: Synthetic peptide
  Seed: ILDTAGLEEYSAMRDQ (NRAS Q61L)
  Core: AGLEEYSAM
  misc_feature (5)..(5): Xaa can be Ala, Cys, Glu, Phe, His, Ile, Lys, Leu, Met, Asn, Pro, Gln, Arg, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Phe, Gly, His, Ile, Lys, Leu, Met, Asn, Pro, Gln, Arg, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ILDTXGLXEXSAXRDQ

SEQ ID NO: 27450 - protein, 24 aa, Artificial Sequence
  Description of Artificial Sequence: Synthetic peptide
  Seed: KQVVIDGETCLLDILDTAGLEEYS (NRAS Q61L)
  Core: ILDTAGLEE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KQVVIDGETCLLDXLDXAXLEXYS

SEQ ID NO: 27451 - protein, 25 aa, Artificial Sequence
  Description of Artificial Sequence: Synthetic peptide
  Seed: KQVVIDGETCLLDILDTAGLEEYSA (NRAS Q61L)
  Core: ILDTAGLEE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KQVVIDGETCLLDXLDXAXLEXYSA

SEQ ID NO: 27452 - protein, 15 aa, Artificial Sequence
  Description of Artificial Sequence: Synthetic peptide
  Seed: LDILDTAGLEEYSAM (NRAS Q61L)
  Core: DTAGLEEYS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Leu, Met, Asn, Pro, Gln, Ser, Thr, Val, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDILXTAXLXEYXAM

SEQ ID NO: 27453 - protein, 16 aa, Artificial Sequence
  Description of Artificial Sequence: Synthetic peptide
  Seed: LDILDTAGLEEYSAMR (NRAS Q61L)
  Core: DTAGLEEYS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDILXTAXLXEYXAMR

SEQ ID NO: 27454 - protein, 17 aa, Artificial Sequence
  Description of Artificial Sequence: Synthetic peptide
  Seed: LDILDTAGLEEYSAMRD (NRAS Q61L)
  Core: DTAGLEEYS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, Ile, Leu, Met, Asn, Pro, Gln, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDILXTAXLXEYXAMRD

SEQ ID NO: 27455 - protein, 19 aa, Artificial Sequence
  Description of Artificial Sequence: Synthetic peptide
  Seed: LDILDTAGLEEYSAMRDQY (NRAS Q61L)
  Core: DTAGLEEYS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Phe, Gly, Ile, Met, Asn, Pro, Ser, Thr, Val, or Trp
  misc_feature (10)..(10): Xaa can be Ala, Cys, Asp, Glu, Gly, Ile, Leu, Met, Asn, Pro, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDILXTAXLXEYXAMRDQY

SEQ ID NO: 27456 - protein, 20 aa, Artificial Sequence
  Description of Artificial Sequence: Synthetic peptide
  Seed: LDILDTAGLEEYSAMRDQYM (NRAS Q61L)
  Core: DTAGLEEYS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDILXTAXLXEYXAMRDQYM

SEQ ID NO: 27457 - protein, 13 aa, Artificial Sequence
  Description of Artificial Sequence: Synthetic peptide
  Seed: LLDILDTAGLEEY (NRAS Q61L)
  Core: ILDTAGLEE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXLEXY

SEQ ID NO: 27458 - protein, 15 aa, Artificial Sequence
  Description of Artificial Sequence: Synthetic peptide
  Seed: LLDILDTAGLEEYSA (NRAS Q61L)
  Core: ILDTAGLEE
  misc_feature (4)..(4): Xaa can be Ala, Cys, Phe, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXLEXYSA

SEQ ID NO: 27459 - protein, 16 aa, Artificial Sequence
  Description of Artificial Sequence: Synthetic peptide
  Seed: LLDILDTAGLEEYSAM (NRAS Q61L)
  Core: DTAGLEEYS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLDILXTAXLXEYXAM

SEQ ID NO: 27460 - protein, 17 aa, Artificial Sequence
  Description of Artificial Sequence: Synthetic peptide
  Seed: LLDILDTAGLEEYSAMR (NRAS Q61L)
  Core: DTAGLEEYS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, Ile, Leu, Met, Asn, Pro, Gln, Ser, Thr, or Val
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLDILXTAXLXEYXAMR

SEQ ID NO: 27461 - protein, 19 aa, Artificial Sequence
  Description of Artificial Sequence: Synthetic peptide
  Seed: LLDILDTAGLEEYSAMRDQ (NRAS Q61L)
  Core: DTAGLEEYS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Phe, Gly, His, Ile, Met, Asn, Pro, Ser, Thr, Val, or Trp
  misc_feature (11)..(11): Xaa can be Ala, Cys, Asp, Glu, Gly, Ile, Leu, Met, Asn, Pro, Gln, Ser, Thr, or Val
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLDILXTAXLXEYXAMRDQ

SEQ ID NO: 27462 - protein, 20 aa, Artificial Sequence
  Description of Artificial Sequence: Synthetic peptide
  Seed: LLDILDTAGLEEYSAMRDQY (NRAS Q61L)
  Core: DTAGLEEYS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LLDILXTAXLXEYXAMRDQY

SEQ ID NO: 27463 - protein, 22 aa, Artificial Sequence
  Description of Artificial Sequence: Synthetic peptide
  Seed: QVVIDGETCLLDILDTAGLEEY (NRAS Q61L)
  Core: ILDTAGLEE
  misc_feature (13)..(13): Xaa can be Cys, Glu, Phe, His, Ile, Lys, Leu, Met, Gln, Arg, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Leu, Met, Asn, Pro, Gln, Ser, Thr, Val, Trp, or Ty r
  misc_feature (21)..(21): Xaa can be Ala, Cys, Asp, Glu, Phe, Gly, His, Ile, Lys, Leu, Met, Asn, Pro, Gln, Arg, Ser, Thr, Val, or Tyr
QVVIDGETCLLDXLDXAXLEXY

SEQ ID NO: 27464 - protein, 23 aa, Artificial Sequence
  Description of Artificial Sequence: Synthetic peptide
  Seed: QVVIDGETCLLDILDTAGLEEYS (NRAS Q61L)
  Core: ILDTAGLEE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXLEXYS

SEQ ID NO: 27465 - protein, 24 aa, Artificial Sequence
  Description of Artificial Sequence: Synthetic peptide
  Seed: QVVIDGETCLLDILDTAGLEEYSA (NRAS Q61L)
  Core: ILDTAGLEE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXLEXYSA

SEQ ID NO: 27466 - protein, 25 aa, Artificial Sequence
  Description of Artificial Sequence: Synthetic peptide
  Seed: QVVIDGETCLLDILDTAGLEEYSAM (NRAS Q61L)
  Core: ILDTAGLEE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXLEXYSAM

SEQ ID NO: 27467 - protein, 14 aa, Artificial Sequence
  Description of Artificial Sequence: Synthetic peptide
  Seed: TCLLDILDTAGLEE (NRAS Q61L)
  Core: ILDTAGLEE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXLEX

SEQ ID NO: 27468 - protein, 15 aa, Artificial Sequence
  Description of Artificial Sequence: Synthetic peptide
  Seed: TCLLDILDTAGLEEY (NRAS Q61L)
  Core: ILDTAGLEE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXLEXY

SEQ ID NO: 27469 - protein, 16 aa, Artificial Sequence
  Description of Artificial Sequence: Synthetic peptide
  Seed: TCLLDILDTAGLEEYS (NRAS Q61L)
  Core: ILDTAGLEE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXLEXYS

SEQ ID NO: 27470 - protein, 19 aa, Artificial Sequence
  Description of Artificial Sequence: Synthetic peptide
  Seed: TCLLDILDTAGLEEYSAMR (NRAS Q61L)
  Core: DTAGLEEYS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Arg, Ser, Thr, Val, Trp, or Tyr
  misc_feature (13)..(13): Xaa can be Ala, Cys, Asp, Glu, Gly, Ile, Leu, Met, Asn, Pro, Gln, Ser, Thr, or Val
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDILXTAXLXEYXAMR

SEQ ID NO: 27471 - protein, 20 aa, Artificial Sequence
  Description of Artificial Sequence: Synthetic peptide
  Seed: TCLLDILDTAGLEEYSAMRD (NRAS Q61L)
  Core: DTAGLEEYS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDILXTAXLXEYXAMRD

SEQ ID NO: 27472 - protein, 20 aa, Artificial Sequence
  Description of Artificial Sequence: Synthetic peptide
  Seed: TCLLDILDTAGLEEYSAMRD (NRAS Q61L)
  Core: AGLEEYSAM
  misc_feature (10)..(10): Xaa can be Ala, Cys, Glu, Phe, His, Ile, Lys, Leu, Met, Gln, Arg, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Phe, His, Ile, Leu, Met, Asn, Pro, Ser, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDILDTXGLXEXSAXRD

SEQ ID NO: 27473 - protein, 21 aa, Artificial Sequence
  Description of Artificial Sequence: Synthetic peptide
  Seed: TCLLDILDTAGLEEYSAMRDQ (NRAS Q61L)
  Core: AGLEEYSAM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDILDTXGLXEXSAXRDQ

SEQ ID NO: 27474 - protein, 22 aa, Artificial Sequence
  Description of Artificial Sequence: Synthetic peptide
  Seed: TCLLDILDTAGLEEYSAMRDQY (NRAS Q61L)
  Core: AGLEEYSAM
  misc_feature (10)..(10): Xaa can be Ala, Cys, Asp, Glu, Phe, His, Ile, Lys, Leu, Met, Pro, Gln, Arg, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDILDTXGLXEXSAXRDQY

SEQ ID NO: 27475 - protein, 23 aa, Artificial Sequence
  Description of Artificial Sequence: Synthetic peptide
  Seed: TCLLDILDTAGLEEYSAMRDQYM (NRAS Q61L)
  Core: DTAGLEEYS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDILXTAXLXEYXAMRDQYM

SEQ ID NO: 27476 - protein, 19 aa, Artificial Sequence
  Description of Artificial Sequence: Synthetic peptide
  Seed: VIDGETCLLDILDTAGLEE (NRAS Q61L)
  Core: ILDTAGLEE
  misc_feature (11)..(11): Xaa can be Ala, Cys, Glu, Phe, His, Ile, Lys, Leu, Met, Gln, Arg, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXLEX

SEQ ID NO: 27477 - protein, 20 aa, Artificial Sequence
  Description of Artificial Sequence: Synthetic peptide
  Seed: VIDGETCLLDILDTAGLEEY (NRAS Q61L)
  Core: ILDTAGLEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXLEXY

SEQ ID NO: 27478 - protein, 21 aa, Artificial Sequence
  Description of Artificial Sequence: Synthetic peptide
  Seed: VIDGETCLLDILDTAGLEEYS (NRAS Q61L)
  Core: ILDTAGLEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXLEXYS

SEQ ID NO: 27479 - protein, 22 aa, Artificial Sequence
  Description of Artificial Sequence: Synthetic peptide
  Seed: VIDGETCLLDILDTAGLEEYSA (NRAS Q61L)
  Core: ILDTAGLEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXLEXYSA

SEQ ID NO: 27480 - protein, 23 aa, Artificial Sequence
  Description of Artificial Sequence: Synthetic peptide
  Seed: VIDGETCLLDILDTAGLEEYSAM (NRAS Q61L)
  Core: ILDTAGLEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXLEXYSAM

SEQ ID NO: 27481 - protein, 24 aa, Artificial Sequence
  Description of Artificial Sequence: Synthetic peptide
  Seed: VIDGETCLLDILDTAGLEEYSAMR (NRAS Q61L)
  Core: ILDTAGLEE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXLEXYSAMR

SEQ ID NO: 27482 - protein, 24 aa, Artificial Sequence
  Description of Artificial Sequence: Synthetic peptide
  Seed: VIDGETCLLDILDTAGLEEYSAMR (NRAS Q61L)
  Core: DTAGLEEYS
  misc_feature (13)..(13): Xaa can be Ala, Asp, Glu, Phe, Gly, His, Ile, Leu, Met, Asn, Pro, Gln, Arg, Ser, Thr, Val, Trp, or Ty r
  misc_feature (16)..(16): Xaa can be Ala, Asp, Glu, Phe, Gly, His, Ile, Met, Asn, Pro, Gln, Ser, Thr, Val, or Trp
  misc_feature (18)..(18): Xaa can be Ala, Asp, Glu, Ile, Pro, Ser, Thr, or Val
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDILXTAXLXEYXAMR

SEQ ID NO: 27483 - protein, 20 aa, Artificial Sequence
  Description of Artificial Sequence: Synthetic peptide
  Seed: VVIDGETCLLDILDTAGLEE (NRAS Q61L)
  Core: ILDTAGLEE
  misc_feature (12)..(12): Xaa can be Cys, Phe, Ile, Lys, Leu, Met, Gln, Arg, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Leu, Met, Asn, Pro, Gln, Ser, Thr, Val, Trp, or Ty r
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXLEX

SEQ ID NO: 27484 - protein, 21 aa, Artificial Sequence
  Description of Artificial Sequence: Synthetic peptide
  Seed: VVIDGETCLLDILDTAGLEEY (NRAS Q61L)
  Core: ILDTAGLEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXLEXY

SEQ ID NO: 27485 - protein, 22 aa, Artificial Sequence
  Description of Artificial Sequence: Synthetic peptide
  Seed: VVIDGETCLLDILDTAGLEEYS (NRAS Q61L)
  Core: ILDTAGLEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXLEXYS

SEQ ID NO: 27486 - protein, 23 aa, Artificial Sequence
  Description of Artificial Sequence: Synthetic peptide
  Seed: VVIDGETCLLDILDTAGLEEYSA (NRAS Q61L)
  Core: ILDTAGLEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXLEXYSA

SEQ ID NO: 27487 - protein, 24 aa, Artificial Sequence
  Description of Artificial Sequence: Synthetic peptide
  Seed: VVIDGETCLLDILDTAGLEEYSAM (NRAS Q61L)
  Core: ILDTAGLEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXLEXYSAM

SEQ ID NO: 27488 - protein, 25 aa, Artificial Sequence
  Description of Artificial Sequence: Synthetic peptide
  Seed: VVIDGETCLLDILDTAGLEEYSAMR (NRAS Q61L)
  Core: ILDTAGLEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXLEXYSAMR

SEQ ID NO: 27489 - protein, 25 aa, Artificial Sequence
  Description of Artificial Sequence: Synthetic peptide
  Seed: VVIDGETCLLDILDTAGLEEYSAMR (NRAS Q61L)
  Core: DTAGLEEYS
  misc_feature (14)..(14): Xaa can be Ala, Asp, Glu, Phe, Gly, His, Ile, Leu, Met, Asn, Pro, Gln, Arg, Ser, Thr, Val, Trp, or Ty r
  misc_feature (17)..(17): Xaa can be Ala, Asp, Glu, Phe, Gly, His, Ile, Met, Asn, Pro, Gln, Ser, Thr, Val, or Trp
  misc_feature (19)..(19): Xaa can be Ala, Asp, Glu, Ile, Pro, Ser, Thr, or Val
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDILXTAXLXEYXAMR

SEQ ID NO: 27490 - protein, 15 aa, Artificial Sequence
  Description of Artificial Sequence: Synthetic peptide
  Seed: CLLDILDTAGREEYS (NRAS Q61R)
  Core: ILDTAGREE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLLDXLDXAXREXYS

SEQ ID NO: 27491 - protein, 16 aa, Artificial Sequence
  Description of Artificial Sequence: Synthetic peptide
  Seed: CLLDILDTAGREEYSA (NRAS Q61R)
  Core: ILDTAGREE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLLDXLDXAXREXYSA

SEQ ID NO: 27492 - protein, 20 aa, Artificial Sequence
  Description of Artificial Sequence: Synthetic peptide
  Seed: CLLDILDTAGREEYSAMRDQ (NRAS Q61R)
  Core: ILDTAGREE
  misc_feature (5)..(5): Xaa can be Ala, Cys, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CLLDXLDXAXREXYSAMRDQ

SEQ ID NO: 27493 - protein, 19 aa, Artificial Sequence
  Description of Artificial Sequence: Synthetic peptide
  Seed: DGETCLLDILDTAGREEYS (NRAS Q61R)
  Core: ILDTAGREE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXREXYS

SEQ ID NO: 27494 - protein, 20 aa, Artificial Sequence
  Description of Artificial Sequence: Synthetic peptide
  Seed: DGETCLLDILDTAGREEYSA (NRAS Q61R)
  Core: ILDTAGREE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXREXYSA

SEQ ID NO: 27495 - protein, 21 aa, Artificial Sequence
  Description of Artificial Sequence: Synthetic peptide
  Seed: DGETCLLDILDTAGREEYSAM (NRAS Q61R)
  Core: ILDTAGREE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXREXYSAM

SEQ ID NO: 27496 - protein, 22 aa, Artificial Sequence
  Description of Artificial Sequence: Synthetic peptide
  Seed: DGETCLLDILDTAGREEYSAMR (NRAS Q61R)
  Core: ILDTAGREE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXREXYSAMR

SEQ ID NO: 27497 - protein, 23 aa, Artificial Sequence
  Description of Artificial Sequence: Synthetic peptide
  Seed: DGETCLLDILDTAGREEYSAMRD (NRAS Q61R)
  Core: ILDTAGREE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXREXYSAMRD

SEQ ID NO: 27498 - protein, 24 aa, Artificial Sequence
  Description of Artificial Sequence: Synthetic peptide
  Seed: DGETCLLDILDTAGREEYSAMRDQ (NRAS Q61R)
  Core: ILDTAGREE
  misc_feature (9)..(9): Xaa can be Ala, Glu, Phe, His, Ile, Lys, Leu, Met, Asn, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXREXYSAMRDQ

SEQ ID NO: 27499 - protein, 25 aa, Artificial Sequence
  Description of Artificial Sequence: Synthetic peptide
  Seed: DGETCLLDILDTAGREEYSAMRDQY (NRAS Q61R)
  Core: ILDTAGREE
  misc_feature (9)..(9): Xaa can be Ala, Glu, Phe, Ile, Lys, Leu, Met, Arg, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DGETCLLDXLDXAXREXYSAMRDQY

SEQ ID NO: 27500 - protein, 15 aa, Artificial Sequence
  Description of Artificial Sequence: Synthetic peptide
  Seed: ETCLLDILDTAGREE (NRAS Q61R)
  Core: ILDTAGREE
  misc_feature (7)..(7): Xaa can be Ala, Cys, Phe, Gly, His, Ile, Lys, Leu, Met, Pro, Gln, Arg, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXREX

SEQ ID NO: 27501 - protein, 16 aa, Artificial Sequence
  Description of Artificial Sequence: Synthetic peptide
  Seed: ETCLLDILDTAGREEY (NRAS Q61R)
  Core: ILDTAGREE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXREXY

SEQ ID NO: 27502 - protein, 17 aa, Artificial Sequence
  Description of Artificial Sequence: Synthetic peptide
  Seed: ETCLLDILDTAGREEYS (NRAS Q61R)
  Core: ILDTAGREE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXREXYS

SEQ ID NO: 27503 - protein, 19 aa, Artificial Sequence
  Description of Artificial Sequence: Synthetic peptide
  Seed: ETCLLDILDTAGREEYSAM (NRAS Q61R)
  Core: ILDTAGREE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXREXYSAM

SEQ ID NO: 27504 - protein, 20 aa, Artificial Sequence
  Description of Artificial Sequence: Synthetic peptide
  Seed: ETCLLDILDTAGREEYSAMR (NRAS Q61R)
  Core: ILDTAGREE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXREXYSAMR

SEQ ID NO: 27505 - protein, 21 aa, Artificial Sequence
  Description of Artificial Sequence: Synthetic peptide
  Seed: ETCLLDILDTAGREEYSAMRD (NRAS Q61R)
  Core: ILDTAGREE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXREXYSAMRD

SEQ ID NO: 27506 - protein, 22 aa, Artificial Sequence
  Description of Artificial Sequence: Synthetic peptide
  Seed: ETCLLDILDTAGREEYSAMRDQ (NRAS Q61R)
  Core: ILDTAGREE
  misc_feature (7)..(7): Xaa can be Ala, Glu, Phe, His, Ile, Lys, Leu, Met, Asn, Gln, Arg, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXREXYSAMRDQ

SEQ ID NO: 27507 - protein, 23 aa, Artificial Sequence
  Description of Artificial Sequence: Synthetic peptide
  Seed: ETCLLDILDTAGREEYSAMRDQY (NRAS Q61R)
  Core: ILDTAGREE
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXREXYSAMRDQY

SEQ ID NO: 27508 - protein, 24 aa, Artificial Sequence
  Description of Artificial Sequence: Synthetic peptide
  Seed: ETCLLDILDTAGREEYSAMRDQYM (NRAS Q61R)
  Core: ILDTAGREE
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ETCLLDXLDXAXREXYSAMRDQYM

SEQ ID NO: 27509 - protein, 16 aa, Artificial Sequence
  Description of Artificial Sequence: Synthetic peptide
  Seed: GETCLLDILDTAGREE (NRAS Q61R)
  Core: ILDTAGREE
  misc_feature (8)..(8): Xaa can be Ala, Cys, Phe, Ile, Leu, Met, Arg, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXREX

SEQ ID NO: 27510 - protein, 17 aa, Artificial Sequence
  Description of Artificial Sequence: Synthetic peptide
  Seed: GETCLLDILDTAGREEY (NRAS Q61R)
  Core: ILDTAGREE
  misc_feature (8)..(8): Xaa can be Ala, Cys, Glu, Phe, Gly, His, Ile, Lys, Leu, Met, Pro, Gln, Arg, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXREXY

SEQ ID NO: 27511 - protein, 19 aa, Artificial Sequence
  Description of Artificial Sequence: Synthetic peptide
  Seed: GETCLLDILDTAGREEYSA (NRAS Q61R)
  Core: ILDTAGREE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXREXYSA

SEQ ID NO: 27512 - protein, 20 aa, Artificial Sequence
  Description of Artificial Sequence: Synthetic peptide
  Seed: GETCLLDILDTAGREEYSAM (NRAS Q61R)
  Core: ILDTAGREE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXREXYSAM

SEQ ID NO: 27513 - protein, 21 aa, Artificial Sequence
  Description of Artificial Sequence: Synthetic peptide
  Seed: GETCLLDILDTAGREEYSAMR (NRAS Q61R)
  Core: ILDTAGREE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXREXYSAMR

SEQ ID NO: 27514 - protein, 22 aa, Artificial Sequence
  Description of Artificial Sequence: Synthetic peptide
  Seed: GETCLLDILDTAGREEYSAMRD (NRAS Q61R)
  Core: ILDTAGREE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXREXYSAMRD

SEQ ID NO: 27515 - protein, 23 aa, Artificial Sequence
  Description of Artificial Sequence: Synthetic peptide
  Seed: GETCLLDILDTAGREEYSAMRDQ (NRAS Q61R)
  Core: ILDTAGREE
  misc_feature (8)..(8): Xaa can be Ala, Glu, Phe, His, Ile, Lys, Leu, Met, Asn, Gln, Arg, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXREXYSAMRDQ

SEQ ID NO: 27516 - protein, 24 aa, Artificial Sequence
  Description of Artificial Sequence: Synthetic peptide
  Seed: GETCLLDILDTAGREEYSAMRDQY (NRAS Q61R)
  Core: ILDTAGREE
  misc_feature (8)..(8): Xaa can be Ala, Phe, Ile, Leu, Met, Arg, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXREXYSAMRDQY

SEQ ID NO: 27517 - protein, 25 aa, Artificial Sequence
  Description of Artificial Sequence: Synthetic peptide
  Seed: GETCLLDILDTAGREEYSAMRDQYM (NRAS Q61R)
  Core: ILDTAGREE
  misc_feature (8)..(8): Xaa can be Ala, Cys, Glu, Phe, His, Ile, Lys, Leu, Met, Pro, Gln, Arg, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GETCLLDXLDXAXREXYSAMRDQYM

SEQ ID NO: 27518 - protein, 19 aa, Artificial Sequence
  Description of Artificial Sequence: Synthetic peptide
  Seed: IDGETCLLDILDTAGREEY (NRAS Q61R)
  Core: ILDTAGREE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXREXY

SEQ ID NO: 27519 - protein, 20 aa, Artificial Sequence
  Description of Artificial Sequence: Synthetic peptide
  Seed: IDGETCLLDILDTAGREEYS (NRAS Q61R)
  Core: ILDTAGREE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXREXYS

SEQ ID NO: 27520 - protein, 21 aa, Artificial Sequence
  Description of Artificial Sequence: Synthetic peptide
  Seed: IDGETCLLDILDTAGREEYSA (NRAS Q61R)
  Core: ILDTAGREE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXREXYSA

SEQ ID NO: 27521 - protein, 22 aa, Artificial Sequence
  Description of Artificial Sequence: Synthetic peptide
  Seed: IDGETCLLDILDTAGREEYSAM (NRAS Q61R)
  Core: ILDTAGREE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXREXYSAM

SEQ ID NO: 27522 - protein, 23 aa, Artificial Sequence
  Description of Artificial Sequence: Synthetic peptide
  Seed: IDGETCLLDILDTAGREEYSAMR (NRAS Q61R)
  Core: ILDTAGREE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXREXYSAMR

SEQ ID NO: 27523 - protein, 24 aa, Artificial Sequence
  Description of Artificial Sequence: Synthetic peptide
  Seed: IDGETCLLDILDTAGREEYSAMRD (NRAS Q61R)
  Core: ILDTAGREE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXREXYSAMRD

SEQ ID NO: 27524 - protein, 25 aa, Artificial Sequence
  Description of Artificial Sequence: Synthetic peptide
  Seed: IDGETCLLDILDTAGREEYSAMRDQ (NRAS Q61R)
  Core: ILDTAGREE
  misc_feature (10)..(10): Xaa can be Ala, Cys, Asp, Glu, Phe, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IDGETCLLDXLDXAXREXYSAMRDQ

SEQ ID NO: 27525 - protein, 24 aa, Artificial Sequence
  Description of Artificial Sequence: Synthetic peptide
  Seed: KQVVIDGETCLLDILDTAGREEYS (NRAS Q61R)
  Core: ILDTAGREE
  misc_feature (14)..(14): Xaa can be Ala, Cys, Glu, Phe, His, Ile, Lys, Leu, Met, Asn, Pro, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KQVVIDGETCLLDXLDXAXREXYS

SEQ ID NO: 27526 - protein, 25 aa, Artificial Sequence
  Description of Artificial Sequence: Synthetic peptide
  Seed: KQVVIDGETCLLDILDTAGREEYSA (NRAS Q61R)
  Core: ILDTAGREE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KQVVIDGETCLLDXLDXAXREXYSA

SEQ ID NO: 27527 - protein, 20 aa, Artificial Sequence
  Description of Artificial Sequence: Synthetic peptide
  Seed: LDILDTAGREEYSAMRDQYM (NRAS Q61R)
  Core: DTAGREEYS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDILXTAXRXEYXAMRDQYM

SEQ ID NO: 27528 - protein, 14 aa, Artificial Sequence
  Description of Artificial Sequence: Synthetic peptide
  Seed: LLDILDTAGREEYS (NRAS Q61R)
  Core: ILDTAGREE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXREXYS

SEQ ID NO: 27529 - protein, 15 aa, Artificial Sequence
  Description of Artificial Sequence: Synthetic peptide
  Seed: LLDILDTAGREEYSA (NRAS Q61R)
  Core: ILDTAGREE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXREXYSA

SEQ ID NO: 27530 - protein, 16 aa, Artificial Sequence
  Description of Artificial Sequence: Synthetic peptide
  Seed: LLDILDTAGREEYSAM (NRAS Q61R)
  Core: ILDTAGREE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXREXYSAM

SEQ ID NO: 27531 - protein, 17 aa, Artificial Sequence
  Description of Artificial Sequence: Synthetic peptide
  Seed: LLDILDTAGREEYSAMR (NRAS Q61R)
  Core: ILDTAGREE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLDXLDXAXREXYSAMR

SEQ ID NO: 27532 - protein, 22 aa, Artificial Sequence
  Description of Artificial Sequence: Synthetic peptide
  Seed: QVVIDGETCLLDILDTAGREEY (NRAS Q61R)
  Core: ILDTAGREE
  misc_feature (13)..(13): Xaa can be Cys, Phe, Ile, Leu, Met, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXREXY

SEQ ID NO: 27533 - protein, 23 aa, Artificial Sequence
  Description of Artificial Sequence: Synthetic peptide
  Seed: QVVIDGETCLLDILDTAGREEYS (NRAS Q61R)
  Core: ILDTAGREE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXREXYS

SEQ ID NO: 27534 - protein, 24 aa, Artificial Sequence
  Description of Artificial Sequence: Synthetic peptide
  Seed: QVVIDGETCLLDILDTAGREEYSA (NRAS Q61R)
  Core: ILDTAGREE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXREXYSA

SEQ ID NO: 27535 - protein, 25 aa, Artificial Sequence
  Description of Artificial Sequence: Synthetic peptide
  Seed: QVVIDGETCLLDILDTAGREEYSAM (NRAS Q61R)
  Core: ILDTAGREE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVVIDGETCLLDXLDXAXREXYSAM

SEQ ID NO: 27536 - protein, 25 aa, Artificial Sequence
  Description of Artificial Sequence: Synthetic peptide
  Seed: RKQVVIDGETCLLDILDTAGREEYS (NRAS Q61R)
  Core: ILDTAGREE
  misc_feature (15)..(15): Xaa can be Ala, Cys, Glu, Phe, His, Ile, Lys, Leu, Met, Asn, Pro, Gln, Arg, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RKQVVIDGETCLLDXLDXAXREXYS

SEQ ID NO: 27537 - protein, 14 aa, Artificial Sequence
  Description of Artificial Sequence: Synthetic peptide
  Seed: TCLLDILDTAGREE (NRAS Q61R)
  Core: ILDTAGREE
  misc_feature (6)..(6): Xaa can be Ala, Cys, Glu, Phe, His, Ile, Lys, Leu, Met, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXREX

SEQ ID NO: 27538 - protein, 15 aa, Artificial Sequence
  Description of Artificial Sequence: Synthetic peptide
  Seed: TCLLDILDTAGREEY (NRAS Q61R)
  Core: ILDTAGREE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXREXY

SEQ ID NO: 27539 - protein, 16 aa, Artificial Sequence
  Description of Artificial Sequence: Synthetic peptide
  Seed: TCLLDILDTAGREEYS (NRAS Q61R)
  Core: ILDTAGREE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXREXYS

SEQ ID NO: 27540 - protein, 17 aa, Artificial Sequence
  Description of Artificial Sequence: Synthetic peptide
  Seed: TCLLDILDTAGREEYSA (NRAS Q61R)
  Core: ILDTAGREE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXREXYSA

SEQ ID NO: 27541 - protein, 19 aa, Artificial Sequence
  Description of Artificial Sequence: Synthetic peptide
  Seed: TCLLDILDTAGREEYSAMR (NRAS Q61R)
  Core: ILDTAGREE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXREXYSAMR

SEQ ID NO: 27542 - protein, 20 aa, Artificial Sequence
  Description of Artificial Sequence: Synthetic peptide
  Seed: TCLLDILDTAGREEYSAMRD (NRAS Q61R)
  Core: ILDTAGREE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXREXYSAMRD

SEQ ID NO: 27543 - protein, 21 aa, Artificial Sequence
  Description of Artificial Sequence: Synthetic peptide
  Seed: TCLLDILDTAGREEYSAMRDQ (NRAS Q61R)
  Core: ILDTAGREE
  misc_feature (6)..(6): Xaa can be Ala, Glu, Phe, His, Ile, Lys, Leu, Met, Gln, Arg, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TCLLDXLDXAXREXYSAMRDQ

SEQ ID NO: 27544 - protein, 23 aa, Artificial Sequence
  Description of Artificial Sequence: Synthetic peptide
  Seed: TCLLDILDTAGREEYSAMRDQYM (NRAS Q61R)
  Core: ILDTAGREE
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Leu, Met, Asn, Pro, Gln, Arg, Ser, Thr, Val, Trp, or Tyr
TCLLDXLDXAXREXYSAMRDQYM

SEQ ID NO: 27545 - protein, 19 aa, Artificial Sequence
  Description of Artificial Sequence: Synthetic peptide
  Seed: VIDGETCLLDILDTAGREE (NRAS Q61R)
  Core: ILDTAGREE
  misc_feature (11)..(11): Xaa can be Ala, Cys, Glu, Phe, His, Ile, Lys, Leu, Met, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXREX

SEQ ID NO: 27546 - protein, 20 aa, Artificial Sequence
  Description of Artificial Sequence: Synthetic peptide
  Seed: VIDGETCLLDILDTAGREEY (NRAS Q61R)
  Core: ILDTAGREE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXREXY

SEQ ID NO: 27547 - protein, 21 aa, Artificial Sequence
  Description of Artificial Sequence: Synthetic peptide
  Seed: VIDGETCLLDILDTAGREEYS (NRAS Q61R)
  Core: ILDTAGREE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXREXYS

SEQ ID NO: 27548 - protein, 22 aa, Artificial Sequence
  Description of Artificial Sequence: Synthetic peptide
  Seed: VIDGETCLLDILDTAGREEYSA (NRAS Q61R)
  Core: ILDTAGREE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXREXYSA

SEQ ID NO: 27549 - protein, 23 aa, Artificial Sequence
  Description of Artificial Sequence: Synthetic peptide
  Seed: VIDGETCLLDILDTAGREEYSAM (NRAS Q61R)
  Core: ILDTAGREE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXREXYSAM

SEQ ID NO: 27550 - protein, 24 aa, Artificial Sequence
  Description of Artificial Sequence: Synthetic peptide
  Seed: VIDGETCLLDILDTAGREEYSAMR (NRAS Q61R)
  Core: ILDTAGREE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXREXYSAMR

SEQ ID NO: 27551 - protein, 25 aa, Artificial Sequence
  Description of Artificial Sequence: Synthetic peptide
  Seed: VIDGETCLLDILDTAGREEYSAMRD (NRAS Q61R)
  Core: ILDTAGREE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VIDGETCLLDXLDXAXREXYSAMRD

SEQ ID NO: 27552 - protein, 20 aa, Artificial Sequence
  Description of Artificial Sequence: Synthetic peptide
  Seed: VVIDGETCLLDILDTAGREE (NRAS Q61R)
  Core: ILDTAGREE
  misc_feature (12)..(12): Xaa can be Cys, Phe, Ile, Leu, Met, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Leu, Met, Asn, Pro, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Ser, Thr, Val, or Ty r
VVIDGETCLLDXLDXAXREX

SEQ ID NO: 27553 - protein, 21 aa, Artificial Sequence
  Description of Artificial Sequence: Synthetic peptide
  Seed: VVIDGETCLLDILDTAGREEY (NRAS Q61R)
  Core: ILDTAGREE
  misc_feature (12)..(12): Xaa can be Ala, Cys, Glu, Phe, His, Ile, Lys, Leu, Met, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXREXY

SEQ ID NO: 27554 - protein, 22 aa, Artificial Sequence
  Description of Artificial Sequence: Synthetic peptide
  Seed: VVIDGETCLLDILDTAGREEYS (NRAS Q61R)
  Core: ILDTAGREE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXREXYS

SEQ ID NO: 27555 - protein, 23 aa, Artificial Sequence
  Description of Artificial Sequence: Synthetic peptide
  Seed: VVIDGETCLLDILDTAGREEYSA (NRAS Q61R)
  Core: ILDTAGREE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXREXYSA

SEQ ID NO: 27556 - protein, 24 aa, Artificial Sequence
  Description of Artificial Sequence: Synthetic peptide
  Seed: VVIDGETCLLDILDTAGREEYSAM (NRAS Q61R)
  Core: ILDTAGREE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXREXYSAM

SEQ ID NO: 27557 - protein, 25 aa, Artificial Sequence
  Description of Artificial Sequence: Synthetic peptide
  Seed: VVIDGETCLLDILDTAGREEYSAMR (NRAS Q61R)
  Core: ILDTAGREE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVIDGETCLLDXLDXAXREXYSAMR

SEQ ID NO: 27558 - protein, 24 aa, Artificial Sequence
  Description of Artificial Sequence: Synthetic peptide
  Seed: DKEQLKAISTRDPLSKITEQEKDF (PIK3CA E542K)
  Core: LSKITEQEK
  misc_feature (14)..(14): Xaa can be Ala, Cys, Phe, His, Ile, Leu, Met, Gln, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DKEQLKAISTRDPXSKXTXQEXDF

SEQ ID NO: 27559 - protein, 25 aa, Artificial Sequence
  Description of Artificial Sequence: Synthetic peptide
  Seed: DKEQLKAISTRDPLSKITEQEKDFL (PIK3CA E542K)
  Core: LSKITEQEK
  misc_feature (14)..(14): Xaa can be Ala, Cys, Phe, Gly, His, Ile, Lys, Leu, Met, Asn, Gln, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DKEQLKAISTRDPXSKXTXQEXDFL

SEQ ID NO: 27560 - protein, 22 aa, Artificial Sequence
  Description of Artificial Sequence: Synthetic peptide
  Seed: EQLKAISTRDPLSKITEQEKDF (PIK3CA E542K)
  Core: LSKITEQEK
  misc_feature (12)..(12): Xaa can be Ala, Cys, Phe, Ile, Leu, Met, Arg, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EQLKAISTRDPXSKXTXQEXDF

SEQ ID NO: 27561 - protein, 23 aa, Artificial Sequence
  Description of Artificial Sequence: Synthetic peptide
  Seed: EQLKAISTRDPLSKITEQEKDFL (PIK3CA E542K)
  Core: LSKITEQEK
  misc_feature (12)..(12): Xaa can be Ala, Cys, Phe, His, Ile, Lys, Leu, Met, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EQLKAISTRDPXSKXTXQEXDFL

SEQ ID NO: 27562 - protein, 24 aa, Artificial Sequence
  Description of Artificial Sequence: Synthetic peptide
  Seed: EQLKAISTRDPLSKITEQEKDFLW (PIK3CA E542K)
  Core: LSKITEQEK
  misc_feature (12)..(12): Xaa can be Ala, Cys, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EQLKAISTRDPXSKXTXQEXDFLW

SEQ ID NO: 27563 - protein, 25 aa, Artificial Sequence
  Description of Artificial Sequence: Synthetic peptide
  Seed: EQLKAISTRDPLSKITEQEKDFLWS (PIK3CA E542K)
  Core: LSKITEQEK
  misc_feature (12)..(12): Xaa can be Ala, Cys, Phe, Gly, His, Ile, Lys, Leu, Met, Asn, Pro, Gln, Arg, Ser, Thr, Val, Trp, or Ty r
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EQLKAISTRDPXSKXTXQEXDFLWS

SEQ ID NO: 27564 - protein, 23 aa, Artificial Sequence
  Description of Artificial Sequence: Synthetic peptide
  Seed: KEQLKAISTRDPLSKITEQEKDF (PIK3CA E542K)
  Core: LSKITEQEK
  misc_feature (13)..(13): Xaa can be Ala, Cys, Phe, Ile, Lys, Leu, Met, Gln, Arg, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KEQLKAISTRDPXSKXTXQEXDF

SEQ ID NO: 27565 - protein, 24 aa, Artificial Sequence
  Description of Artificial Sequence: Synthetic peptide
  Seed: KEQLKAISTRDPLSKITEQEKDFL (PIK3CA E542K)
  Core: LSKITEQEK
  misc_feature (13)..(13): Xaa can be Ala, Cys, Phe, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KEQLKAISTRDPXSKXTXQEXDFL

SEQ ID NO: 27566 - protein, 25 aa, Artificial Sequence
  Description of Artificial Sequence: Synthetic peptide
  Seed: KEQLKAISTRDPLSKITEQEKDFLW (PIK3CA E542K)
  Core: LSKITEQEK
  misc_feature (13)..(13): Xaa can be Ala, Cys, Phe, Gly, His, Ile, Lys, Leu, Met, Asn, Pro, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KEQLKAISTRDPXSKXTXQEXDFLW

SEQ ID NO: 27567 - protein, 20 aa, Artificial Sequence
  Description of Artificial Sequence: Synthetic peptide
  Seed: QLKAISTRDPLSKITEQEKD (PIK3CA E542K)
  Core: LSKITEQEK
  misc_feature (11)..(11): Xaa can be Ala, Phe, Ile, Leu, Met, Arg, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLKAISTRDPXSKXTXQEXD

SEQ ID NO: 27568 - protein, 21 aa, Artificial Sequence
  Description of Artificial Sequence: Synthetic peptide
  Seed: QLKAISTRDPLSKITEQEKDF (PIK3CA E542K)
  Core: LSKITEQEK
  misc_feature (11)..(11): Xaa can be Ala, Phe, Ile, Leu, Met, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLKAISTRDPXSKXTXQEXDF

SEQ ID NO: 27569 - protein, 22 aa, Artificial Sequence
  Description of Artificial Sequence: Synthetic peptide
  Seed: QLKAISTRDPLSKITEQEKDFL (PIK3CA E542K)
  Core: LSKITEQEK
  misc_feature (11)..(11): Xaa can be Ala, Cys, Phe, Ile, Leu, Met, Arg, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLKAISTRDPXSKXTXQEXDFL

SEQ ID NO: 27570 - protein, 23 aa, Artificial Sequence
  Description of Artificial Sequence: Synthetic peptide
  Seed: QLKAISTRDPLSKITEQEKDFLW (PIK3CA E542K)
  Core: LSKITEQEK
  misc_feature (11)..(11): Xaa can be Ala, Cys, Phe, His, Ile, Lys, Leu, Met, Asn, Gln, Arg, Ser, Thr, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLKAISTRDPXSKXTXQEXDFLW

SEQ ID NO: 27571 - protein, 24 aa, Artificial Sequence
  Description of Artificial Sequence: Synthetic peptide
  Seed: QLKAISTRDPLSKITEQEKDFLWS (PIK3CA E542K)
  Core: LSKITEQEK
  misc_feature (11)..(11): Xaa can be Ala, Cys, Phe, Gly, His, Ile, Lys, Leu, Met, Pro, Gln, Arg, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLKAISTRDPXSKXTXQEXDFLWS

SEQ ID NO: 27572 - protein, 25 aa, Artificial Sequence
  Description of Artificial Sequence: Synthetic peptide
  Seed: RDPLSKITEQEKDFLWSHRHYCVTI (PIK3CA E542K)
  Core: LSKITEQEK
  misc_feature (4)..(4): Xaa can be Ala, Cys, Asp, Glu, Phe, Gly, His, Ile, Lys, Leu, Met, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RDPXSKXTXQEXDFLWSHRHYCVTI

SEQ ID NO: 27573 - protein, 20 aa, Artificial Sequence
  Description of Artificial Sequence: Synthetic peptide
  Seed: DPLSEITKQEKDFLWSHRHY (PIK3CA E545K)
  Core: ITKQEKDFL
  misc_feature (6)..(6): Xaa can be Phe, Ile, Leu, Met, Val, Trp, or Tyr
  misc_feature (9)..(9): Xaa can be Ala, Cys, Phe, His, Ile, Lys, Leu, Met, Asn, Gln, Arg, Ser, Thr, Val, Trp, or Tyr
  misc_feature (11)..(11): Xaa can be Ala, His, Ile, Lys, Leu, Met, Asn, Pro, Gln, Arg, Ser, Thr, or Val
  misc_feature (14)..(14): Xaa can be Ala, Asp, Glu, Phe, Gly, His, Ile, Lys, Leu, Met, Asn, Pro, Gln, Arg, Ser, Thr, Val, Trp, or Tyr
DPLSEXTKXEXDFXWSHRHY

SEQ ID NO: 27574 - protein, 21 aa, Artificial Sequence
  Description of Artificial Sequence: Synthetic peptide
  Seed: DPLSEITKQEKDFLWSHRHYC (PIK3CA E545K)
  Core: ITKQEKDFL
  misc_feature (6)..(6): Xaa can be Phe, Ile, Leu, Met, Arg, Val, Trp, or Tyr
  misc_feature (9)..(9): Xaa can be Ala, Cys, Phe, His, Ile, Lys, Leu, Met, Asn, Gln, Arg, Ser, Thr, Val, Trp, or Tyr
  misc_feature (11)..(11): Xaa can be Ala, His, Ile, Lys, Leu, Asn, Pro, Gln, Arg, Ser, Thr, or Val
  misc_feature (14)..(14): Xaa can be Ala, Glu, Phe, Gly, His, Ile, Lys, Leu, Met, Asn, Gln, Arg, Ser, Thr, Val, Trp, or Tyr
DPLSEXTKXEXDFXWSHRHYC

SEQ ID NO: 27575 - protein, 22 aa, Artificial Sequence
  Description of Artificial Sequence: Synthetic peptide
  Seed: DPLSEITKQEKDFLWSHRHYCV (PIK3CA E545K)
  Core: ITKQEKDFL
  misc_feature (6)..(6): Xaa can be Ala, Cys, Glu, Phe, His, Ile, Lys, Leu, Met, Gln, Arg, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPLSEXTKXEXDFXWSHRHYCV

SEQ ID NO: 27576 - protein, 23 aa, Artificial Sequence
  Description of Artificial Sequence: Synthetic peptide
  Seed: DPLSEITKQEKDFLWSHRHYCVT (PIK3CA E545K)
  Core: ITKQEKDFL
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPLSEXTKXEXDFXWSHRHYCVT

SEQ ID NO: 27577 - protein, 24 aa, Artificial Sequence
  Description of Artificial Sequence: Synthetic peptide
  Seed: DPLSEITKQEKDFLWSHRHYCVTI (PIK3CA E545K)
  Core: ITKQEKDFL
  misc_feature (6)..(6): Xaa can be Phe, Ile, Leu, Met, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Asp, Glu, Gly, His, Lys, Leu, Asn, Pro, Gln, Arg, Ser, Thr, or Val
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPLSEXTKXEXDFXWSHRHYCVTI

SEQ ID NO: 27578 - protein, 25 aa, Artificial Sequence
  Description of Artificial Sequence: Synthetic peptide
  Seed: DPLSEITKQEKDFLWSHRHYCVTIP (PIK3CA E545K)
  Core: ITKQEKDFL
  misc_feature (6)..(6): Xaa can be Phe, Ile, Leu, Met, Val, Trp, or Tyr
  misc_feature (9)..(9): Xaa can be Ala, Cys, Asp, Glu, Phe, His, Ile, Lys, Leu, Met, Asn, Gln, Arg, Ser, Thr, Val, Trp, or Ty r
  misc_feature (11)..(11): Xaa can be Ala, Asp, Glu, His, Lys, Leu, Asn, Pro, Gln, Arg, Ser, Thr, or Val
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPLSEXTKXEXDFXWSHRHYCVTIP

SEQ ID NO: 27579 - protein, 15 aa, Artificial Sequence
  Description of Artificial Sequence: Synthetic peptide
  Seed: LSEITKQEKDFLWSH (PIK3CA E545K)
  Core: ITKQEKDFL
  misc_feature (4)..(4): Xaa can be Ala, Cys, Phe, His, Ile, Leu, Met, Thr, Val, Trp, or Tyr
  misc_feature (7)..(7): Xaa can be Ala, Cys, Phe, His, Ile, Lys, Leu, Met, Asn, Gln, Arg, Ser, Thr, Val, Trp, or Tyr
  misc_feature (9)..(9): Xaa can be Ala, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSEXTKXEXDFXWSH

SEQ ID NO: 27580 - protein, 20 aa, Artificial Sequence
  Description of Artificial Sequence: Synthetic peptide
  Seed: LSEITKQEKDFLWSHRHYCV (PIK3CA E545K)
  Core: ITKQEKDFL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LSEXTKXEXDFXWSHRHYCV

SEQ ID NO: 27581 - protein, 20 aa, Artificial Sequence
  Description of Artificial Sequence: Synthetic peptide
  Seed: LSEITKQEKDFLWSHRHYCV (PIK3CA E545K)
  Core: TKQEKDFLW
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LSEIXKQXKXFLXSHRHYCV

SEQ ID NO: 27582 - protein, 21 aa, Artificial Sequence
  Description of Artificial Sequence: Synthetic peptide
  Seed: LSEITKQEKDFLWSHRHYCVT (PIK3CA E545K)
  Core: ITKQEKDFL
  misc_feature (4)..(4): Xaa can be Phe, Ile, Leu, Met, Val, Trp, or Tyr
  misc_feature (7)..(7): Xaa can be Ala, Cys, Asp, Glu, Phe, His, Ile, Lys, Leu, Met, Asn, Gln, Arg, Ser, Thr, Val, Trp, or Ty r
  misc_feature (9)..(9): Xaa can be Ala, Glu, His, Lys, Asn, Gln, Arg, Ser, Thr, Val, or Tyr
  misc_feature (12)..(12): Xaa can be Ala, Cys, Phe, Gly, His, Ile, Lys, Leu, Met, Asn, Pro, Gln, Arg, Ser, Thr, Val, Trp, or Ty r
LSEXTKXEXDFXWSHRHYCVT

SEQ ID NO: 27583 - protein, 22 aa, Artificial Sequence
  Description of Artificial Sequence: Synthetic peptide
  Seed: LSEITKQEKDFLWSHRHYCVTI (PIK3CA E545K)
  Core: ITKQEKDFL
  misc_feature (4)..(4): Xaa can be Phe, Ile, Leu, Met, Val, Trp, or Tyr
  misc_feature (7)..(7): Xaa can be Ala, Asp, Glu, Phe, His, Ile, Lys, Leu, Met, Asn, Gln, Arg, Ser, Thr, Val, Trp, or Tyr
  misc_feature (9)..(9): Xaa can be Ala, His, Lys, Asn, Gln, Arg, Ser, Thr, or Val
  misc_feature (12)..(12): Xaa can be Ala, Cys, Glu, Phe, Gly, His, Ile, Lys, Leu, Met, Asn, Pro, Gln, Arg, Ser, Thr, Val, Trp, or Tyr
LSEXTKXEXDFXWSHRHYCVTI

SEQ ID NO: 27584 - protein, 15 aa, Artificial Sequence
  Description of Artificial Sequence: Synthetic peptide
  Seed: PLSEITKQEKDFLWS (PIK3CA E545K)
  Core: ITKQEKDFL
  misc_feature (5)..(5): Xaa can be Ala, Phe, Ile, Leu, Met, Thr, Val, Trp, or Tyr
  misc_feature (8)..(8): Xaa can be Ala, Cys, Phe, Gly, His, Ile, Lys, Leu, Met, Asn, Gln, Arg, Ser, Thr, Val, Trp, or Tyr
  misc_feature (10)..(10): Xaa can be Ala, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLSEXTKXEXDFXWS

SEQ ID NO: 27585 - protein, 20 aa, Artificial Sequence
  Description of Artificial Sequence: Synthetic peptide
  Seed: PLSEITKQEKDFLWSHRHYC (PIK3CA E545K)
  Core: ITKQEKDFL
  misc_feature (5)..(5): Xaa can be Ala, Cys, Glu, Phe, His, Ile, Lys, Leu, Met, Asn, Gln, Arg, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLSEXTKXEXDFXWSHRHYC

SEQ ID NO: 27586 - protein, 21 aa, Artificial Sequence
  Description of Artificial Sequence: Synthetic peptide
  Seed: PLSEITKQEKDFLWSHRHYCV (PIK3CA E545K)
  Core: ITKQEKDFL
  misc_feature (5)..(5): Xaa can be Ala, Cys, Glu, Phe, His, Ile, Lys, Leu, Met, Gln, Arg, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLSEXTKXEXDFXWSHRHYCV

SEQ ID NO: 27587 - protein, 22 aa, Artificial Sequence
  Description of Artificial Sequence: Synthetic peptide
  Seed: PLSEITKQEKDFLWSHRHYCVT (PIK3CA E545K)
  Core: ITKQEKDFL
  misc_feature (5)..(5): Xaa can be Phe, Ile, Leu, Met, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLSEXTKXEXDFXWSHRHYCVT

SEQ ID NO: 27588 - protein, 23 aa, Artificial Sequence
  Description of Artificial Sequence: Synthetic peptide
  Seed: PLSEITKQEKDFLWSHRHYCVTI (PIK3CA E545K)
  Core: ITKQEKDFL
  misc_feature (5)..(5): Xaa can be Phe, Ile, Leu, Met, Val, Trp, or Tyr
  misc_feature (8)..(8): Xaa can be Ala, Cys, Asp, Glu, Phe, His, Ile, Lys, Leu, Met, Asn, Gln, Arg, Ser, Thr, Val, Trp, or Ty r
  misc_feature (10)..(10): Xaa can be Ala, Glu, Gly, His, Ile, Lys, Leu, Asn, Pro, Gln, Arg, Ser, Thr, Val, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLSEXTKXEXDFXWSHRHYCVTI

SEQ ID NO: 27589 - protein, 24 aa, Artificial Sequence
  Description of Artificial Sequence: Synthetic peptide
  Seed: PLSEITKQEKDFLWSHRHYCVTIP (PIK3CA E545K)
  Core: ITKQEKDFL
  misc_feature (5)..(5): Xaa can be Phe, Ile, Leu, Met, Val, Trp, or Tyr
  misc_feature (8)..(8): Xaa can be Ala, Cys, Asp, Glu, Phe, His, Ile, Lys, Leu, Met, Asn, Gln, Arg, Ser, Thr, Val, Trp, or Ty r
  misc_feature (10)..(10): Xaa can be Ala, Glu, His, Ile, Lys, Leu, Asn, Pro, Gln, Arg, Ser, Thr, Val, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLSEXTKXEXDFXWSHRHYCVTIP

SEQ ID NO: 27590 - protein, 25 aa, Artificial Sequence
  Description of Artificial Sequence: Synthetic peptide
  Seed: PLSEITKQEKDFLWSHRHYCVTIPE (PIK3CA E545K)
  Core: ITKQEKDFL
  misc_feature (5)..(5): Xaa can be Phe, Ile, Leu, Met, Val, Trp, or Tyr
  misc_feature (8)..(8): Xaa can be Ala, Cys, Asp, Glu, Phe, His, Ile, Lys, Leu, Met, Asn, Gln, Arg, Ser, Thr, Val, Trp, or Ty r
  misc_feature (10)..(10): Xaa can be Ala, Glu, Phe, His, Ile, Lys, Leu, Asn, Pro, Gln, Arg, Ser, Thr, Val, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PLSEXTKXEXDFXWSHRHYCVTIPE

SEQ ID NO: 27591 - protein, 21 aa, Artificial Sequence
  Description of Artificial Sequence: Synthetic peptide
  Seed: RDPLSEITKQEKDFLWSHRHY (PIK3CA E545K)
  Core: ITKQEKDFL
  misc_feature (7)..(7): Xaa can be Phe, Ile, Leu, Met, Val, or Trp
  misc_feature (10)..(10): Xaa can be Ala, Cys, Phe, His, Ile, Lys, Leu, Met, Gln, Arg, Ser, Thr, Val, Trp, or Tyr
  misc_feature (12)..(12): Xaa can be Ala, His, Lys, Pro, Arg, or Thr
  misc_feature (15)..(15): Xaa can be Ala, Phe, Gly, His, Ile, Lys, Leu, Met, Asn, Gln, Arg, Ser, Thr, Val, Trp, or Tyr
RDPLSEXTKXEXDFXWSHRHY

SEQ ID NO: 27592 - protein, 22 aa, Artificial Sequence
  Description of Artificial Sequence: Synthetic peptide
  Seed: RDPLSEITKQEKDFLWSHRHYC (PIK3CA E545K)
  Core: ITKQEKDFL
  misc_feature (7)..(7): Xaa can be Phe, Ile, Leu, Met, Val, Trp, or Tyr
  misc_feature (10)..(10): Xaa can be Ala, Cys, Phe, His, Ile, Lys, Leu, Met, Asn, Gln, Arg, Ser, Thr, Val, Trp, or Tyr
  misc_feature (12)..(12): Xaa can be Ala, His, Lys, Asn, Pro, Arg, or Thr
  misc_feature (15)..(15): Xaa can be Ala, Glu, Phe, Gly, His, Ile, Lys, Leu, Met, Asn, Gln, Arg, Ser, Thr, Val, Trp, or Tyr
RDPLSEXTKXEXDFXWSHRHYC

SEQ ID NO: 27593 - protein, 23 aa, Artificial Sequence
  Description of Artificial Sequence: Synthetic peptide
  Seed: RDPLSEITKQEKDFLWSHRHYCV (PIK3CA E545K)
  Core: ITKQEKDFL
  misc_feature (7)..(7): Xaa can be Ala, Cys, Glu, Phe, His, Ile, Lys, Leu, Met, Gln, Arg, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RDPLSEXTKXEXDFXWSHRHYCV

SEQ ID NO: 27594 - protein, 24 aa, Artificial Sequence
  Description of Artificial Sequence: Synthetic peptide
  Seed: RDPLSEITKQEKDFLWSHRHYCVT (PIK3CA E545K)
  Core: ITKQEKDFL
  misc_feature (7)..(7): Xaa can be Ala, Cys, Glu, Phe, His, Ile, Lys, Leu, Met, Gln, Arg, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RDPLSEXTKXEXDFXWSHRHYCVT

SEQ ID NO: 27595 - protein, 25 aa, Artificial Sequence
  Description of Artificial Sequence: Synthetic peptide
  Seed: RDPLSEITKQEKDFLWSHRHYCVTI (PIK3CA E545K)
  Core: ITKQEKDFL
  misc_feature (7)..(7): Xaa can be Phe, His, Ile, Lys, Leu, Met, Arg, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RDPLSEXTKXEXDFXWSHRHYCVTI

SEQ ID NO: 27596 - protein, 19 aa, Artificial Sequence
  Description of Artificial Sequence: Synthetic peptide
  Seed: SEITKQEKDFLWSHRHYCV (PIK3CA E545K)
  Core: ITKQEKDFL
  misc_feature (3)..(3): Xaa can be Phe, Ile, Leu, Met, Val, Trp, or Tyr
  misc_feature (6)..(6): Xaa can be Ala, Asp, Glu, Phe, His, Ile, Lys, Leu, Met, Asn, Gln, Arg, Ser, Thr, Val, Trp, or Tyr
  misc_feature (8)..(8): Xaa can be Ala, His, Lys, or Arg
  misc_feature (11)..(11): Xaa can be Ala, Phe, His, Ile, Lys, Leu, Met, Arg, Ser, Val, Trp, or Tyr
SEXTKXEXDFXWSHRHYCV

SEQ ID NO: 27597 - protein, 25 aa, Artificial Sequence
  Description of Artificial Sequence: Synthetic peptide
  Seed: STRDPLSEITKQEKDFLWSHRHYCV (PIK3CA E545K)
  Core: ITKQEKDFL
  misc_feature (9)..(9): Xaa can be Ala, Cys, Glu, Phe, His, Ile, Lys, Leu, Met, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STRDPLSEXTKXEXDFXWSHRHYCV

SEQ ID NO: 27598 - protein, 24 aa, Artificial Sequence
  Description of Artificial Sequence: Synthetic peptide
  Seed: TRDPLSEITKQEKDFLWSHRHYCV (PIK3CA E545K)
  Core: ITKQEKDFL
  misc_feature (8)..(8): Xaa can be Ala, Cys, Glu, Phe, His, Ile, Lys, Leu, Met, Gln, Arg, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TRDPLSEXTKXEXDFXWSHRHYCV

SEQ ID NO: 27599 - protein, 25 aa, Artificial Sequence
  Description of Artificial Sequence: Synthetic peptide
  Seed: TRDPLSEITKQEKDFLWSHRHYCVT (PIK3CA E545K)
  Core: ITKQEKDFL
  misc_feature (8)..(8): Xaa can be Ala, Cys, Glu, Phe, His, Ile, Lys, Leu, Met, Gln, Arg, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TRDPLSEXTKXEXDFXWSHRHYCVT

SEQ ID NO: 27600 - protein, 23 aa, Artificial Sequence
  Description of Artificial Sequence: Synthetic peptide
  Seed: ALDKTEQEALEYFMKQMNDARHG (PIK3CA H1047R)
  Core: MKQMNDARH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Gln, Ser, Thr, Val, Trp, or Ty r
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALDKTEQEALEYFXKQXNXARXG

SEQ ID NO: 27601 - protein, 24 aa, Artificial Sequence
  Description of Artificial Sequence: Synthetic peptide
  Seed: ALDKTEQEALEYFMKQMNDARHGG (PIK3CA H1047R)
  Core: MKQMNDARH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALDKTEQEALEYFXKQXNXARXGG

SEQ ID NO: 27602 - protein, 25 aa, Artificial Sequence
  Description of Artificial Sequence: Synthetic peptide
  Seed: ALDKTEQEALEYFMKQMNDARHGGW (PIK3CA H1047R)
  Core: MKQMNDARH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ALDKTEQEALEYFXKQXNXARXGGW

SEQ ID NO: 27603 - protein, 14 aa, Artificial Sequence
  Description of Artificial Sequence: Synthetic peptide
  Seed: ALEYFMKQMNDARH (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARX

SEQ ID NO: 27604 - protein, 15 aa, Artificial Sequence
  Description of Artificial Sequence: Synthetic peptide
  Seed: ALEYFMKQMNDARHG (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXG

SEQ ID NO: 27605 - protein, 16 aa, Artificial Sequence
  Description of Artificial Sequence: Synthetic peptide
  Seed: ALEYFMKQMNDARHGG (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXGG

SEQ ID NO: 27606 - protein, 17 aa, Artificial Sequence
  Description of Artificial Sequence: Synthetic peptide
  Seed: ALEYFMKQMNDARHGGW (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXGGW

SEQ ID NO: 27607 - protein, 19 aa, Artificial Sequence
  Description of Artificial Sequence: Synthetic peptide
  Seed: ALEYFMKQMNDARHGGWTT (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXGGWTT

SEQ ID NO: 27608 - protein, 20 aa, Artificial Sequence
  Description of Artificial Sequence: Synthetic peptide
  Seed: ALEYFMKQMNDARHGGWTTK (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXGGWTTK

SEQ ID NO: 27609 - protein, 21 aa, Artificial Sequence
  Description of Artificial Sequence: Synthetic peptide
  Seed: ALEYFMKQMNDARHGGWTTKM (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXGGWTTKM

SEQ ID NO: 27610 - protein, 22 aa, Artificial Sequence
  Description of Artificial Sequence: Synthetic peptide
  Seed: ALEYFMKQMNDARHGGWTTKMD (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXGGWTTKMD

SEQ ID NO: 27611 - protein, 23 aa, Artificial Sequence
  Description of Artificial Sequence: Synthetic peptide
  Seed: ALEYFMKQMNDARHGGWTTKMDW (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXGGWTTKMDW

SEQ ID NO: 27612 - protein, 24 aa, Artificial Sequence
  Description of Artificial Sequence: Synthetic peptide
  Seed: ALEYFMKQMNDARHGGWTTKMDWI (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXGGWTTKMDWI

SEQ ID NO: 27613 - protein, 25 aa, Artificial Sequence
  Description of Artificial Sequence: Synthetic peptide
  Seed: ALEYFMKQMNDARHGGWTTKMDWIF (PIK3CA H1047R)
  Core: MKQMNDARH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALEYFXKQXNXARXGGWTTKMDWIF

SEQ ID NO: 27614 - protein, 21 aa, Artificial Sequence
  Description of Artificial Sequence: Synthetic peptide
  Seed: DKTEQEALEYFMKQMNDARHG (PIK3CA H1047R)
  Core: MKQMNDARH
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Leu, Met, Asn, Gln, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DKTEQEALEYFXKQXNXARXG

SEQ ID NO: 27615 - protein, 22 aa, Artificial Sequence
  Description of Artificial Sequence: Synthetic peptide
  Seed: DKTEQEALEYFMKQMNDARHGG (PIK3CA H1047R)
  Core: MKQMNDARH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DKTEQEALEYFXKQXNXARXGG

SEQ ID NO: 27616 - protein, 23 aa, Artificial Sequence
  Description of Artificial Sequence: Synthetic peptide
  Seed: DKTEQEALEYFMKQMNDARHGGW (PIK3CA H1047R)
  Core: MKQMNDARH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DKTEQEALEYFXKQXNXARXGGW

SEQ ID NO: 27617 - protein, 24 aa, Artificial Sequence
  Description of Artificial Sequence: Synthetic peptide
  Seed: DKTEQEALEYFMKQMNDARHGGWT (PIK3CA H1047R)
  Core: MKQMNDARH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DKTEQEALEYFXKQXNXARXGGWT

SEQ ID NO: 27618 - protein, 25 aa, Artificial Sequence
  Description of Artificial Sequence: Synthetic peptide
  Seed: DKTEQEALEYFMKQMNDARHGGWTT (PIK3CA H1047R)
  Core: MKQMNDARH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DKTEQEALEYFXKQXNXARXGGWTT

SEQ ID NO: 27619 - protein, 15 aa, Artificial Sequence
  Description of Artificial Sequence: Synthetic peptide
  Seed: EALEYFMKQMNDARH (PIK3CA H1047R)
  Core: MKQMNDARH
  misc_feature (7)..(7): Xaa can be Ala, Cys, Glu, Phe, Gly, His, Ile, Leu, Met, Asn, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARX

SEQ ID NO: 27620 - protein, 16 aa, Artificial Sequence
  Description of Artificial Sequence: Synthetic peptide
  Seed: EALEYFMKQMNDARHG (PIK3CA H1047R)
  Core: MKQMNDARH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARXG

SEQ ID NO: 27621 - protein, 17 aa, Artificial Sequence
  Description of Artificial Sequence: Synthetic peptide
  Seed: EALEYFMKQMNDARHGG (PIK3CA H1047R)
  Core: MKQMNDARH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARXGG

SEQ ID NO: 27622 - protein, 19 aa, Artificial Sequence
  Description of Artificial Sequence: Synthetic peptide
  Seed: EALEYFMKQMNDARHGGWT (PIK3CA H1047R)
  Core: MKQMNDARH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARXGGWT

SEQ ID NO: 27623 - protein, 20 aa, Artificial Sequence
  Description of Artificial Sequence: Synthetic peptide
  Seed: EALEYFMKQMNDARHGGWTT (PIK3CA H1047R)
  Core: MKQMNDARH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARXGGWTT

SEQ ID NO: 27624 - protein, 21 aa, Artificial Sequence
  Description of Artificial Sequence: Synthetic peptide
  Seed: EALEYFMKQMNDARHGGWTTK (PIK3CA H1047R)
  Core: MKQMNDARH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARXGGWTTK

SEQ ID NO: 27625 - protein, 22 aa, Artificial Sequence
  Description of Artificial Sequence: Synthetic peptide
  Seed: EALEYFMKQMNDARHGGWTTKM (PIK3CA H1047R)
  Core: MKQMNDARH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARXGGWTTKM

SEQ ID NO: 27626 - protein, 23 aa, Artificial Sequence
  Description of Artificial Sequence: Synthetic peptide
  Seed: EALEYFMKQMNDARHGGWTTKMD (PIK3CA H1047R)
  Core: MKQMNDARH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARXGGWTTKMD

SEQ ID NO: 27627 - protein, 24 aa, Artificial Sequence
  Description of Artificial Sequence: Synthetic peptide
  Seed: EALEYFMKQMNDARHGGWTTKMDW (PIK3CA H1047R)
  Core: MKQMNDARH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARXGGWTTKMDW

SEQ ID NO: 27628 - protein, 25 aa, Artificial Sequence
  Description of Artificial Sequence: Synthetic peptide
  Seed: EALEYFMKQMNDARHGGWTTKMDWI (PIK3CA H1047R)
  Core: MKQMNDARH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EALEYFXKQXNXARXGGWTTKMDWI

SEQ ID NO: 27629 - protein, 19 aa, Artificial Sequence
  Description of Artificial Sequence: Synthetic peptide
  Seed: EQEALEYFMKQMNDARHGG (PIK3CA H1047R)
  Core: MKQMNDARH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EQEALEYFXKQXNXARXGG

SEQ ID NO: 27630 - protein, 20 aa, Artificial Sequence
  Description of Artificial Sequence: Synthetic peptide
  Seed: EQEALEYFMKQMNDARHGGW (PIK3CA H1047R)
  Core: MKQMNDARH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EQEALEYFXKQXNXARXGGW

SEQ ID NO: 27631 - protein, 21 aa, Artificial Sequence
  Description of Artificial Sequence: Synthetic peptide
  Seed: EQEALEYFMKQMNDARHGGWT (PIK3CA H1047R)
  Core: MKQMNDARH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EQEALEYFXKQXNXARXGGWT

SEQ ID NO: 27632 - protein, 22 aa, Artificial Sequence
  Description of Artificial Sequence: Synthetic peptide
  Seed: EQEALEYFMKQMNDARHGGWTT (PIK3CA H1047R)
  Core: MKQMNDARH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EQEALEYFXKQXNXARXGGWTT

SEQ ID NO: 27633 - protein, 23 aa, Artificial Sequence
  Description of Artificial Sequence: Synthetic peptide
  Seed: EQEALEYFMKQMNDARHGGWTTK (PIK3CA H1047R)
  Core: MKQMNDARH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EQEALEYFXKQXNXARXGGWTTK

SEQ ID NO: 27634 - protein, 24 aa, Artificial Sequence
  Description of Artificial Sequence: Synthetic peptide
  Seed: EQEALEYFMKQMNDARHGGWTTKM (PIK3CA H1047R)
  Core: MKQMNDARH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EQEALEYFXKQXNXARXGGWTTKM

SEQ ID NO: 27635 - protein, 25 aa, Artificial Sequence
  Description of Artificial Sequence: Synthetic peptide
  Seed: EQEALEYFMKQMNDARHGGWTTKMD (PIK3CA H1047R)
  Core: MKQMNDARH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EQEALEYFXKQXNXARXGGWTTKMD

SEQ ID NO: 27636 - protein, 15 aa, Artificial Sequence
  Description of Artificial Sequence: Synthetic peptide
  Seed: EYFMKQMNDARHGGW (PIK3CA H1047R)
  Core: MKQMNDARH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYFXKQXNXARXGGW

SEQ ID NO: 27637 - protein, 17 aa, Artificial Sequence
  Description of Artificial Sequence: Synthetic peptide
  Seed: EYFMKQMNDARHGGWTT (PIK3CA H1047R)
  Core: MKQMNDARH
  misc_feature (4)..(4): Xaa can be Ala, Cys, Phe, His, Ile, Leu, Met, Asn, Gln, Thr, Val, Trp, or Tyr
  misc_feature (7)..(7): Xaa can be Ala, Cys, Asp, Glu, Phe, Gly, His, Ile, Leu, Met, Asn, Gln, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYFXKQXNXARXGGWTT

SEQ ID NO: 27638 - protein, 20 aa, Artificial Sequence
  Description of Artificial Sequence: Synthetic peptide
  Seed: EYFMKQMNDARHGGWTTKMD (PIK3CA H1047R)
  Core: MKQMNDARH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYFXKQXNXARXGGWTTKMD

SEQ ID NO: 27639 - protein, 24 aa, Artificial Sequence
  Description of Artificial Sequence: Synthetic peptide
  Seed: EYFMKQMNDARHGGWTTKMDWIFH (PIK3CA H1047R)
  Core: MKQMNDARH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYFXKQXNXARXGGWTTKMDWIFH

SEQ ID NO: 27640 - protein, 25 aa, Artificial Sequence
  Description of Artificial Sequence: Synthetic peptide
  Seed: EYFMKQMNDARHGGWTTKMDWIFHT (PIK3CA H1047R)
  Core: MKQMNDARH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EYFXKQXNXARXGGWTTKMDWIFHT

SEQ ID NO: 27641 - protein, 20 aa, Artificial Sequence
  Description of Artificial Sequence: Synthetic peptide
  Seed: KTEQEALEYFMKQMNDARHG (PIK3CA H1047R)
  Core: MKQMNDARH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTEQEALEYFXKQXNXARXG

SEQ ID NO: 27642 - protein, 21 aa, Artificial Sequence
  Description of Artificial Sequence: Synthetic peptide
  Seed: KTEQEALEYFMKQMNDARHGG (PIK3CA H1047R)
  Core: MKQMNDARH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTEQEALEYFXKQXNXARXGG

SEQ ID NO: 27643 - protein, 22 aa, Artificial Sequence
  Description of Artificial Sequence: Synthetic peptide
  Seed: KTEQEALEYFMKQMNDARHGGW (PIK3CA H1047R)
  Core: MKQMNDARH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTEQEALEYFXKQXNXARXGGW

SEQ ID NO: 27644 - protein, 23 aa, Artificial Sequence
  Description of Artificial Sequence: Synthetic peptide
  Seed: KTEQEALEYFMKQMNDARHGGWT (PIK3CA H1047R)
  Core: MKQMNDARH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTEQEALEYFXKQXNXARXGGWT

SEQ ID NO: 27645 - protein, 24 aa, Artificial Sequence
  Description of Artificial Sequence: Synthetic peptide
  Seed: KTEQEALEYFMKQMNDARHGGWTT (PIK3CA H1047R)
  Core: MKQMNDARH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTEQEALEYFXKQXNXARXGGWTT

SEQ ID NO: 27646 - protein, 25 aa, Artificial Sequence
  Description of Artificial Sequence: Synthetic peptide
  Seed: KTEQEALEYFMKQMNDARHGGWTTK (PIK3CA H1047R)
  Core: MKQMNDARH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KTEQEALEYFXKQXNXARXGGWTTK

SEQ ID NO: 27647 - protein, 24 aa, Artificial Sequence
  Description of Artificial Sequence: Synthetic peptide
  Seed: LALDKTEQEALEYFMKQMNDARHG (PIK3CA H1047R)
  Core: MKQMNDARH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Gln, Ser, Thr, Val, Trp, or Ty r
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LALDKTEQEALEYFXKQXNXARXG

SEQ ID NO: 27648 - protein, 25 aa, Artificial Sequence
  Description of Artificial Sequence: Synthetic peptide
  Seed: LALDKTEQEALEYFMKQMNDARHGG (PIK3CA H1047R)
  Core: MKQMNDARH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LALDKTEQEALEYFXKQXNXARXGG

SEQ ID NO: 27649 - protein, 22 aa, Artificial Sequence
  Description of Artificial Sequence: Synthetic peptide
  Seed: LDKTEQEALEYFMKQMNDARHG (PIK3CA H1047R)
  Core: MKQMNDARH
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDKTEQEALEYFXKQXNXARXG

SEQ ID NO: 27650 - protein, 23 aa, Artificial Sequence
  Description of Artificial Sequence: Synthetic peptide
  Seed: LDKTEQEALEYFMKQMNDARHGG (PIK3CA H1047R)
  Core: MKQMNDARH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDKTEQEALEYFXKQXNXARXGG

SEQ ID NO: 27651 - protein, 24 aa, Artificial Sequence
  Description of Artificial Sequence: Synthetic peptide
  Seed: LDKTEQEALEYFMKQMNDARHGGW (PIK3CA H1047R)
  Core: MKQMNDARH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDKTEQEALEYFXKQXNXARXGGW

SEQ ID NO: 27652 - protein, 25 aa, Artificial Sequence
  Description of Artificial Sequence: Synthetic peptide
  Seed: LDKTEQEALEYFMKQMNDARHGGWT (PIK3CA H1047R)
  Core: MKQMNDARH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDKTEQEALEYFXKQXNXARXGGWT

SEQ ID NO: 27653 - protein, 14 aa, Artificial Sequence
  Description of Artificial Sequence: Synthetic peptide
  Seed: LEYFMKQMNDARHG (PIK3CA H1047R)
  Core: MKQMNDARH
  misc_feature (5)..(5): Xaa can be Ala, Cys, Phe, Ile, Leu, Met, Thr, Val, Trp, or Tyr
  misc_feature (8)..(8): Xaa can be Ala, Cys, Asp, Glu, Phe, Gly, His, Ile, Lys, Leu, Met, Asn, Gln, Ser, Thr, Val, Trp, or Ty r
  misc_feature (10)..(10): Xaa can be Ala, Cys, Asp, Glu, Gly, His, Ile, Lys, Leu, Met, Asn, Pro, Gln, Arg, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXG

SEQ ID NO: 27654 - protein, 15 aa, Artificial Sequence
  Description of Artificial Sequence: Synthetic peptide
  Seed: LEYFMKQMNDARHGG (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGG

SEQ ID NO: 27655 - protein, 16 aa, Artificial Sequence
  Description of Artificial Sequence: Synthetic peptide
  Seed: LEYFMKQMNDARHGGW (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGGW

SEQ ID NO: 27656 - protein, 17 aa, Artificial Sequence
  Description of Artificial Sequence: Synthetic peptide
  Seed: LEYFMKQMNDARHGGWT (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGGWT

SEQ ID NO: 27657 - protein, 19 aa, Artificial Sequence
  Description of Artificial Sequence: Synthetic peptide
  Seed: LEYFMKQMNDARHGGWTTK (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGGWTTK

SEQ ID NO: 27658 - protein, 20 aa, Artificial Sequence
  Description of Artificial Sequence: Synthetic peptide
  Seed: LEYFMKQMNDARHGGWTTKM (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGGWTTKM

SEQ ID NO: 27659 - protein, 21 aa, Artificial Sequence
  Description of Artificial Sequence: Synthetic peptide
  Seed: LEYFMKQMNDARHGGWTTKMD (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGGWTTKMD

SEQ ID NO: 27660 - protein, 22 aa, Artificial Sequence
  Description of Artificial Sequence: Synthetic peptide
  Seed: LEYFMKQMNDARHGGWTTKMDW (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGGWTTKMDW

SEQ ID NO: 27661 - protein, 23 aa, Artificial Sequence
  Description of Artificial Sequence: Synthetic peptide
  Seed: LEYFMKQMNDARHGGWTTKMDWI (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGGWTTKMDWI

SEQ ID NO: 27662 - protein, 24 aa, Artificial Sequence
  Description of Artificial Sequence: Synthetic peptide
  Seed: LEYFMKQMNDARHGGWTTKMDWIF (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGGWTTKMDWIF

SEQ ID NO: 27663 - protein, 25 aa, Artificial Sequence
  Description of Artificial Sequence: Synthetic peptide
  Seed: LEYFMKQMNDARHGGWTTKMDWIFH (PIK3CA H1047R)
  Core: MKQMNDARH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LEYFXKQXNXARXGGWTTKMDWIFH

SEQ ID NO: 27664 - protein, 16 aa, Artificial Sequence
  Description of Artificial Sequence: Synthetic peptide
  Seed: QEALEYFMKQMNDARH (PIK3CA H1047R)
  Core: MKQMNDARH
  misc_feature (8)..(8): Xaa can be Phe, Ile, Leu, Met, Val, Trp, or Tyr
  misc_feature (11)..(11): Xaa can be Ala, Cys, Glu, Phe, Ile, Leu, Met, Gln, Ser, Thr, Val, Trp, or Tyr
  misc_feature (13)..(13): Xaa can be Ala, Cys, Asp, Glu, Gly, His, Ile, Lys, Leu, Met, Asn, Pro, Gln, Arg, Ser, Thr, or Val
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARX

SEQ ID NO: 27665 - protein, 17 aa, Artificial Sequence
  Description of Artificial Sequence: Synthetic peptide
  Seed: QEALEYFMKQMNDARHG (PIK3CA H1047R)
  Core: MKQMNDARH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARXG

SEQ ID NO: 27666 - protein, 18 aa, Artificial Sequence
  Description of Artificial Sequence: Synthetic peptide
  Seed: QEALEYFMKQMNDARHGG (PIK3CA H1047R)
  Core: MKQMNDARH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Glu, Phe, Gly, His, Ile, Leu, Met, Asn, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARXGG

SEQ ID NO: 27667 - protein, 19 aa, Artificial Sequence
  Description of Artificial Sequence: Synthetic peptide
  Seed: QEALEYFMKQMNDARHGGW (PIK3CA H1047R)
  Core: MKQMNDARH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARXGGW

SEQ ID NO: 27668 - protein, 20 aa, Artificial Sequence
  Description of Artificial Sequence: Synthetic peptide
  Seed: QEALEYFMKQMNDARHGGWT (PIK3CA H1047R)
  Core: MKQMNDARH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARXGGWT

SEQ ID NO: 27669 - protein, 21 aa, Artificial Sequence
  Description of Artificial Sequence: Synthetic peptide
  Seed: QEALEYFMKQMNDARHGGWTT (PIK3CA H1047R)
  Core: MKQMNDARH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARXGGWTT

SEQ ID NO: 27670 - protein, 22 aa, Artificial Sequence
  Description of Artificial Sequence: Synthetic peptide
  Seed: QEALEYFMKQMNDARHGGWTTK (PIK3CA H1047R)
  Core: MKQMNDARH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARXGGWTTK

SEQ ID NO: 27671 - protein, 23 aa, Artificial Sequence
  Description of Artificial Sequence: Synthetic peptide
  Seed: QEALEYFMKQMNDARHGGWTTKM (PIK3CA H1047R)
  Core: MKQMNDARH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARXGGWTTKM

SEQ ID NO: 27672 - protein, 24 aa, Artificial Sequence
  Description of Artificial Sequence: Synthetic peptide
  Seed: QEALEYFMKQMNDARHGGWTTKMD (PIK3CA H1047R)
  Core: MKQMNDARH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARXGGWTTKMD

SEQ ID NO: 27673 - protein, 25 aa, Artificial Sequence
  Description of Artificial Sequence: Synthetic peptide
  Seed: QEALEYFMKQMNDARHGGWTTKMDW (PIK3CA H1047R)
  Core: MKQMNDARH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEALEYFXKQXNXARXGGWTTKMDW

SEQ ID NO: 27674 - protein, 19 aa, Artificial Sequence
  Description of Artificial Sequence: Synthetic peptide
  Seed: TEQEALEYFMKQMNDARHG (PIK3CA H1047R)
  Core: MKQMNDARH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Leu, Met, Asn, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TEQEALEYFXKQXNXARXG

SEQ ID NO: 27675 - protein, 20 aa, Artificial Sequence
  Description of Artificial Sequence: Synthetic peptide
  Seed: TEQEALEYFMKQMNDARHGG (PIK3CA H1047R)
  Core: MKQMNDARH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TEQEALEYFXKQXNXARXGG

SEQ ID NO: 27676 - protein, 21 aa, Artificial Sequence
  Description of Artificial Sequence: Synthetic peptide
  Seed: TEQEALEYFMKQMNDARHGGW (PIK3CA H1047R)
  Core: MKQMNDARH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TEQEALEYFXKQXNXARXGGW

SEQ ID NO: 27677 - protein, 22 aa, Artificial Sequence
  Description of Artificial Sequence: Synthetic peptide
  Seed: TEQEALEYFMKQMNDARHGGWT (PIK3CA H1047R)
  Core: MKQMNDARH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TEQEALEYFXKQXNXARXGGWT

SEQ ID NO: 27678 - protein, 23 aa, Artificial Sequence
  Description of Artificial Sequence: Synthetic peptide
  Seed: TEQEALEYFMKQMNDARHGGWTT (PIK3CA H1047R)
  Core: MKQMNDARH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TEQEALEYFXKQXNXARXGGWTT

SEQ ID NO: 27679 - protein, 24 aa, Artificial Sequence
  Description of Artificial Sequence: Synthetic peptide
  Seed: TEQEALEYFMKQMNDARHGGWTTK (PIK3CA H1047R)
  Core: MKQMNDARH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TEQEALEYFXKQXNXARXGGWTTK

SEQ ID NO: 27680 - protein, 25 aa, Artificial Sequence
  Description of Artificial Sequence: Synthetic peptide
  Seed: TEQEALEYFMKQMNDARHGGWTTKM (PIK3CA H1047R)
  Core: MKQMNDARH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TEQEALEYFXKQXNXARXGGWTTKM

SEQ ID NO: 27681 - protein, 25 aa, Artificial Sequence
  Description of Artificial Sequence: Synthetic peptide
  Seed: TLALDKTEQEALEYFMKQMNDARHG (PIK3CA H1047R)
  Core: MKQMNDARH
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Gln, Ser, Thr, Val, Trp, or Ty r
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
TLALDKTEQEALEYFXKQXNXARXG

SEQ ID NO: 27682 - protein, 15 aa, Artificial Sequence
  Description of Artificial Sequence: Synthetic peptide
  Seed: YFMKQMNDARHGGWT (PIK3CA H1047R)
  Core: MKQMNDARH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YFXKQXNXARXGGWT

SEQ ID NO: 27683 - protein, 24 aa, Artificial Sequence
  Description of Artificial Sequence: Synthetic peptide
  Seed: YFMKQMNDARHGGWTTKMDWIFHT (PIK3CA H1047R)
  Core: MKQMNDARH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YFXKQXNXARXGGWTTKMDWIFHT

SEQ ID NO: 27684 - protein, 17 aa, Artificial Sequence
  Description of Artificial Sequence: Synthetic peptide
  Seed: AEREEFFDETRQLCDLR (PIK3CA R88Q)
  Core: FFDETRQLC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AEREEXFDXTXQLXDLR

SEQ ID NO: 27685 - protein, 19 aa, Artificial Sequence
  Description of Artificial Sequence: Synthetic peptide
  Seed: AEREEFFDETRQLCDLRLF (PIK3CA R88Q)
  Core: FFDETRQLC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AEREEXFDXTXQLXDLRLF

SEQ ID NO: 27686 - protein, 20 aa, Artificial Sequence
  Description of Artificial Sequence: Synthetic peptide
  Seed: AEREEFFDETRQLCDLRLFQ (PIK3CA R88Q)
  Core: FFDETRQLC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AEREEXFDXTXQLXDLRLFQ

SEQ ID NO: 27687 - protein, 20 aa, Artificial Sequence
  Description of Artificial Sequence: Synthetic peptide
  Seed: AEREEFFDETRQLCDLRLFQ (PIK3CA R88Q)
  Core: TRQLCDLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDEXRQXCXLRXFQ

SEQ ID NO: 27688 - protein, 21 aa, Artificial Sequence
  Description of Artificial Sequence: Synthetic peptide
  Seed: AEREEFFDETRQLCDLRLFQP (PIK3CA R88Q)
  Core: FFDETRQLC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AEREEXFDXTXQLXDLRLFQP

SEQ ID NO: 27689 - protein, 21 aa, Artificial Sequence
  Description of Artificial Sequence: Synthetic peptide
  Seed: AEREEFFDETRQLCDLRLFQP (PIK3CA R88Q)
  Core: TRQLCDLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDEXRQXCXLRXFQP

SEQ ID NO: 27690 - protein, 21 aa, Artificial Sequence
  Description of Artificial Sequence: Synthetic peptide
  Seed: AEREEFFDETRQLCDLRLFQP (PIK3CA R88Q)
  Core: RQLCDLRLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDETXQLXDXRLXQP

SEQ ID NO: 27691 - protein, 22 aa, Artificial Sequence
  Description of Artificial Sequence: Synthetic peptide
  Seed: AEREEFFDETRQLCDLRLFQPF (PIK3CA R88Q)
  Core: FFDETRQLC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AEREEXFDXTXQLXDLRLFQPF

SEQ ID NO: 27692 - protein, 22 aa, Artificial Sequence
  Description of Artificial Sequence: Synthetic peptide
  Seed: AEREEFFDETRQLCDLRLFQPF (PIK3CA R88Q)
  Core: TRQLCDLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDEXRQXCXLRXFQPF

SEQ ID NO: 27693 - protein, 22 aa, Artificial Sequence
  Description of Artificial Sequence: Synthetic peptide
  Seed: AEREEFFDETRQLCDLRLFQPF (PIK3CA R88Q)
  Core: RQLCDLRLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDETXQLXDXRLXQPF

SEQ ID NO: 27694 - protein, 23 aa, Artificial Sequence
  Description of Artificial Sequence: Synthetic peptide
  Seed: AEREEFFDETRQLCDLRLFQPFL (PIK3CA R88Q)
  Core: FFDETRQLC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AEREEXFDXTXQLXDLRLFQPFL

SEQ ID NO: 27695 - protein, 23 aa, Artificial Sequence
  Description of Artificial Sequence: Synthetic peptide
  Seed: AEREEFFDETRQLCDLRLFQPFL (PIK3CA R88Q)
  Core: TRQLCDLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDEXRQXCXLRXFQPFL

SEQ ID NO: 27696 - protein, 23 aa, Artificial Sequence
  Description of Artificial Sequence: Synthetic peptide
  Seed: AEREEFFDETRQLCDLRLFQPFL (PIK3CA R88Q)
  Core: RQLCDLRLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDETXQLXDXRLXQPFL

SEQ ID NO: 27697 - protein, 24 aa, Artificial Sequence
  Description of Artificial Sequence: Synthetic peptide
  Seed: AEREEFFDETRQLCDLRLFQPFLK (PIK3CA R88Q)
  Core: FFDETRQLC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AEREEXFDXTXQLXDLRLFQPFLK

SEQ ID NO: 27698 - protein, 24 aa, Artificial Sequence
  Description of Artificial Sequence: Synthetic peptide
  Seed: AEREEFFDETRQLCDLRLFQPFLK (PIK3CA R88Q)
  Core: TRQLCDLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDEXRQXCXLRXFQPFLK

SEQ ID NO: 27699 - protein, 24 aa, Artificial Sequence
  Description of Artificial Sequence: Synthetic peptide
  Seed: AEREEFFDETRQLCDLRLFQPFLK (PIK3CA R88Q)
  Core: RQLCDLRLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDETXQLXDXRLXQPFLK

SEQ ID NO: 27700 - protein, 25 aa, Artificial Sequence
  Description of Artificial Sequence: Synthetic peptide
  Seed: AEREEFFDETRQLCDLRLFQPFLKV (PIK3CA R88Q)
  Core: FFDETRQLC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AEREEXFDXTXQLXDLRLFQPFLKV

SEQ ID NO: 27701 - protein, 25 aa, Artificial Sequence
  Description of Artificial Sequence: Synthetic peptide
  Seed: AEREEFFDETRQLCDLRLFQPFLKV (PIK3CA R88Q)
  Core: TRQLCDLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDEXRQXCXLRXFQPFLKV

SEQ ID NO: 27702 - protein, 25 aa, Artificial Sequence
  Description of Artificial Sequence: Synthetic peptide
  Seed: AEREEFFDETRQLCDLRLFQPFLKV (PIK3CA R88Q)
  Core: RQLCDLRLF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEREEFFDETXQLXDXRLXQPFLKV

SEQ ID NO: 27703 - protein, 15 aa, Artificial Sequence
  Description of Artificial Sequence: Synthetic peptide
  Seed: DETRQLCDLRLFQPF (PIK3CA R88Q)
  Core: TRQLCDLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXRQXCXLRXFQPF

SEQ ID NO: 27704 - protein, 15 aa, Artificial Sequence
  Description of Artificial Sequence: Synthetic peptide
  Seed: DETRQLCDLRLFQPF (PIK3CA R88Q)
  Core: RQLCDLRLF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DETXQLXDXRLXQPF

SEQ ID NO: 27705 - protein, 16 aa, Artificial Sequence
  Description of Artificial Sequence: Synthetic peptide
  Seed: DETRQLCDLRLFQPFL (PIK3CA R88Q)
  Core: TRQLCDLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXRQXCXLRXFQPFL

SEQ ID NO: 27706 - protein, 16 aa, Artificial Sequence
  Description of Artificial Sequence: Synthetic peptide
  Seed: DETRQLCDLRLFQPFL (PIK3CA R88Q)
  Core: RQLCDLRLF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DETXQLXDXRLXQPFL

SEQ ID NO: 27707 - protein, 17 aa, Artificial Sequence
  Description of Artificial Sequence: Synthetic peptide
  Seed: DETRQLCDLRLFQPFLK (PIK3CA R88Q)
  Core: TRQLCDLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXRQXCXLRXFQPFLK

SEQ ID NO: 27708 - protein, 17 aa, Artificial Sequence
  Description of Artificial Sequence: Synthetic peptide
  Seed: DETRQLCDLRLFQPFLK (PIK3CA R88Q)
  Core: RQLCDLRLF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DETXQLXDXRLXQPFLK

SEQ ID NO: 27709 - protein, 18 aa, Artificial Sequence
  Description of Artificial Sequence: Synthetic peptide
  Seed: DETRQLCDLRLFQPFLKV (PIK3CA R88Q)
  Core: TRQLCDLRL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXRQXCXLRXFQPFLKV

SEQ ID NO: 27710 - protein, 18 aa, Artificial Sequence
  Description of Artificial Sequence: Synthetic peptide
  Seed: DETRQLCDLRLFQPFLKV (PIK3CA R88Q)
  Core: RQLCDLRLF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DETXQLXDXRLXQPFLKV

SEQ ID NO: 27711 - protein, 19 aa, Artificial Sequence
  Description of Artificial Sequence: Synthetic peptide
  Seed: DETRQLCDLRLFQPFLKVI (PIK3CA R88Q)
  Core: RQLCDLRLF
  misc_feature (4)..(4): Xaa can be Cys, Glu, Phe, His, Ile, Lys, Leu, Met, Asn, Pro, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DETXQLXDXRLXQPFLKVI

SEQ ID NO: 27712 - protein, 19 aa, Artificial Sequence
  Description of Artificial Sequence: Synthetic peptide
  Seed: EAEREEFFDETRQLCDLRL (PIK3CA R88Q)
  Core: FFDETRQLC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEXFDXTXQLXDLRL

SEQ ID NO: 27713 - protein, 20 aa, Artificial Sequence
  Description of Artificial Sequence: Synthetic peptide
  Seed: EAEREEFFDETRQLCDLRLF (PIK3CA R88Q)
  Core: FFDETRQLC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEXFDXTXQLXDLRLF

SEQ ID NO: 27714 - protein, 20 aa, Artificial Sequence
  Description of Artificial Sequence: Synthetic peptide
  Seed: EAEREEFFDETRQLCDLRLF (PIK3CA R88Q)
  Core: TRQLCDLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDEXRQXCXLRXF

SEQ ID NO: 27715 - protein, 21 aa, Artificial Sequence
  Description of Artificial Sequence: Synthetic peptide
  Seed: EAEREEFFDETRQLCDLRLFQ (PIK3CA R88Q)
  Core: FFDETRQLC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEXFDXTXQLXDLRLFQ

SEQ ID NO: 27716 - protein, 21 aa, Artificial Sequence
  Description of Artificial Sequence: Synthetic peptide
  Seed: EAEREEFFDETRQLCDLRLFQ (PIK3CA R88Q)
  Core: TRQLCDLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDEXRQXCXLRXFQ

SEQ ID NO: 27717 - protein, 22 aa, Artificial Sequence
  Description of Artificial Sequence: Synthetic peptide
  Seed: EAEREEFFDETRQLCDLRLFQP (PIK3CA R88Q)
  Core: FFDETRQLC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEXFDXTXQLXDLRLFQP

SEQ ID NO: 27718 - protein, 22 aa, Artificial Sequence
  Description of Artificial Sequence: Synthetic peptide
  Seed: EAEREEFFDETRQLCDLRLFQP (PIK3CA R88Q)
  Core: TRQLCDLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDEXRQXCXLRXFQP

SEQ ID NO: 27719 - protein, 22 aa, Artificial Sequence
  Description of Artificial Sequence: Synthetic peptide
  Seed: EAEREEFFDETRQLCDLRLFQP (PIK3CA R88Q)
  Core: RQLCDLRLF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Glu, Phe, Gly, His, Ile, Lys, Leu, Met, Asn, Pro, Gln, Ser, Thr, Val, Trp, or Ty r
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDETXQLXDXRLXQP

SEQ ID NO: 27720 - protein, 23 aa, Artificial Sequence
  Description of Artificial Sequence: Synthetic peptide
  Seed: EAEREEFFDETRQLCDLRLFQPF (PIK3CA R88Q)
  Core: FFDETRQLC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEXFDXTXQLXDLRLFQPF

SEQ ID NO: 27721 - protein, 23 aa, Artificial Sequence
  Description of Artificial Sequence: Synthetic peptide
  Seed: EAEREEFFDETRQLCDLRLFQPF (PIK3CA R88Q)
  Core: TRQLCDLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDEXRQXCXLRXFQPF

SEQ ID NO: 27722 - protein, 23 aa, Artificial Sequence
  Description of Artificial Sequence: Synthetic peptide
  Seed: EAEREEFFDETRQLCDLRLFQPF (PIK3CA R88Q)
  Core: RQLCDLRLF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDETXQLXDXRLXQPF

SEQ ID NO: 27723 - protein, 24 aa, Artificial Sequence
  Description of Artificial Sequence: Synthetic peptide
  Seed: EAEREEFFDETRQLCDLRLFQPFL (PIK3CA R88Q)
  Core: FFDETRQLC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEXFDXTXQLXDLRLFQPFL

SEQ ID NO: 27724 - protein, 24 aa, Artificial Sequence
  Description of Artificial Sequence: Synthetic peptide
  Seed: EAEREEFFDETRQLCDLRLFQPFL (PIK3CA R88Q)
  Core: TRQLCDLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDEXRQXCXLRXFQPFL

SEQ ID NO: 27725 - protein, 24 aa, Artificial Sequence
  Description of Artificial Sequence: Synthetic peptide
  Seed: EAEREEFFDETRQLCDLRLFQPFL (PIK3CA R88Q)
  Core: RQLCDLRLF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDETXQLXDXRLXQPFL

SEQ ID NO: 27726 - protein, 25 aa, Artificial Sequence
  Description of Artificial Sequence: Synthetic peptide
  Seed: EAEREEFFDETRQLCDLRLFQPFLK (PIK3CA R88Q)
  Core: FFDETRQLC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEXFDXTXQLXDLRLFQPFLK

SEQ ID NO: 27727 - protein, 25 aa, Artificial Sequence
  Description of Artificial Sequence: Synthetic peptide
  Seed: EAEREEFFDETRQLCDLRLFQPFLK (PIK3CA R88Q)
  Core: TRQLCDLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDEXRQXCXLRXFQPFLK

SEQ ID NO: 27728 - protein, 25 aa, Artificial Sequence
  Description of Artificial Sequence: Synthetic peptide
  Seed: EAEREEFFDETRQLCDLRLFQPFLK (PIK3CA R88Q)
  Core: RQLCDLRLF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EAEREEFFDETXQLXDXRLXQPFLK

SEQ ID NO: 27729 - protein, 15 aa, Artificial Sequence
  Description of Artificial Sequence: Synthetic peptide
  Seed: EEFFDETRQLCDLRL (PIK3CA R88Q)
  Core: FFDETRQLC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXFDXTXQLXDLRL

SEQ ID NO: 27730 - protein, 16 aa, Artificial Sequence
  Description of Artificial Sequence: Synthetic peptide
  Seed: EEFFDETRQLCDLRLF (PIK3CA R88Q)
  Core: FFDETRQLC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXFDXTXQLXDLRLF

SEQ ID NO: 27731 - protein, 16 aa, Artificial Sequence
  Description of Artificial Sequence: Synthetic peptide
  Seed: EEFFDETRQLCDLRLF (PIK3CA R88Q)
  Core: TRQLCDLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDEXRQXCXLRXF

SEQ ID NO: 27732 - protein, 17 aa, Artificial Sequence
  Description of Artificial Sequence: Synthetic peptide
  Seed: EEFFDETRQLCDLRLFQ (PIK3CA R88Q)
  Core: FFDETRQLC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXFDXTXQLXDLRLFQ

SEQ ID NO: 27733 - protein, 17 aa, Artificial Sequence
  Description of Artificial Sequence: Synthetic peptide
  Seed: EEFFDETRQLCDLRLFQ (PIK3CA R88Q)
  Core: TRQLCDLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDEXRQXCXLRXFQ

SEQ ID NO: 27734 - protein, 17 aa, Artificial Sequence
  Description of Artificial Sequence: Synthetic peptide
  Seed: EEFFDETRQLCDLRLFQ (PIK3CA R88Q)
  Core: RQLCDLRLF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDETXQLXDXRLXQ

SEQ ID NO: 27735 - protein, 19 aa, Artificial Sequence
  Description of Artificial Sequence: Synthetic peptide
  Seed: EEFFDETRQLCDLRLFQPF (PIK3CA R88Q)
  Core: FFDETRQLC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXFDXTXQLXDLRLFQPF

SEQ ID NO: 27736 - protein, 19 aa, Artificial Sequence
  Description of Artificial Sequence: Synthetic peptide
  Seed: EEFFDETRQLCDLRLFQPF (PIK3CA R88Q)
  Core: TRQLCDLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDEXRQXCXLRXFQPF

SEQ ID NO: 27737 - protein, 19 aa, Artificial Sequence
  Description of Artificial Sequence: Synthetic peptide
  Seed: EEFFDETRQLCDLRLFQPF (PIK3CA R88Q)
  Core: RQLCDLRLF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDETXQLXDXRLXQPF

SEQ ID NO: 27738 - protein, 20 aa, Artificial Sequence
  Description of Artificial Sequence: Synthetic peptide
  Seed: EEFFDETRQLCDLRLFQPFL (PIK3CA R88Q)
  Core: FFDETRQLC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXFDXTXQLXDLRLFQPFL

SEQ ID NO: 27739 - protein, 20 aa, Artificial Sequence
  Description of Artificial Sequence: Synthetic peptide
  Seed: EEFFDETRQLCDLRLFQPFL (PIK3CA R88Q)
  Core: TRQLCDLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDEXRQXCXLRXFQPFL

SEQ ID NO: 27740 - protein, 20 aa, Artificial Sequence
  Description of Artificial Sequence: Synthetic peptide
  Seed: EEFFDETRQLCDLRLFQPFL (PIK3CA R88Q)
  Core: RQLCDLRLF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDETXQLXDXRLXQPFL

SEQ ID NO: 27741 - protein, 21 aa, Artificial Sequence
  Description of Artificial Sequence: Synthetic peptide
  Seed: EEFFDETRQLCDLRLFQPFLK (PIK3CA R88Q)
  Core: FFDETRQLC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXFDXTXQLXDLRLFQPFLK

SEQ ID NO: 27742 - protein, 21 aa, Artificial Sequence
  Description of Artificial Sequence: Synthetic peptide
  Seed: EEFFDETRQLCDLRLFQPFLK (PIK3CA R88Q)
  Core: TRQLCDLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDEXRQXCXLRXFQPFLK

SEQ ID NO: 27743 - protein, 21 aa, Artificial Sequence
  Description of Artificial Sequence: Synthetic peptide
  Seed: EEFFDETRQLCDLRLFQPFLK (PIK3CA R88Q)
  Core: RQLCDLRLF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDETXQLXDXRLXQPFLK

SEQ ID NO: 27744 - protein, 22 aa, Artificial Sequence
  Description of Artificial Sequence: Synthetic peptide
  Seed: EEFFDETRQLCDLRLFQPFLKV (PIK3CA R88Q)
  Core: FFDETRQLC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXFDXTXQLXDLRLFQPFLKV

SEQ ID NO: 27745 - protein, 22 aa, Artificial Sequence
  Description of Artificial Sequence: Synthetic peptide
  Seed: EEFFDETRQLCDLRLFQPFLKV (PIK3CA R88Q)
  Core: TRQLCDLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDEXRQXCXLRXFQPFLKV

SEQ ID NO: 27746 - protein, 22 aa, Artificial Sequence
  Description of Artificial Sequence: Synthetic peptide
  Seed: EEFFDETRQLCDLRLFQPFLKV (PIK3CA R88Q)
  Core: RQLCDLRLF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDETXQLXDXRLXQPFLKV

SEQ ID NO: 27747 - protein, 23 aa, Artificial Sequence
  Description of Artificial Sequence: Synthetic peptide
  Seed: EEFFDETRQLCDLRLFQPFLKVI (PIK3CA R88Q)
  Core: FFDETRQLC
  misc_feature (3)..(3): Xaa can be Cys, Phe, His, Ile, Lys, Leu, Met, Gln, Arg, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXFDXTXQLXDLRLFQPFLKVI

SEQ ID NO: 27748 - protein, 23 aa, Artificial Sequence
  Description of Artificial Sequence: Synthetic peptide
  Seed: EEFFDETRQLCDLRLFQPFLKVI (PIK3CA R88Q)
  Core: TRQLCDLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDEXRQXCXLRXFQPFLKVI

SEQ ID NO: 27749 - protein, 23 aa, Artificial Sequence
  Description of Artificial Sequence: Synthetic peptide
  Seed: EEFFDETRQLCDLRLFQPFLKVI (PIK3CA R88Q)
  Core: RQLCDLRLF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDETXQLXDXRLXQPFLKVI

SEQ ID NO: 27750 - protein, 24 aa, Artificial Sequence
  Description of Artificial Sequence: Synthetic peptide
  Seed: EEFFDETRQLCDLRLFQPFLKVIE (PIK3CA R88Q)
  Core: FFDETRQLC
  misc_feature (3)..(3): Xaa can be Phe, Ile, Leu, Met, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Glu, His, Ile, Lys, Asn, Pro, Gln, Arg, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXFDXTXQLXDLRLFQPFLKVIE

SEQ ID NO: 27751 - protein, 24 aa, Artificial Sequence
  Description of Artificial Sequence: Synthetic peptide
  Seed: EEFFDETRQLCDLRLFQPFLKVIE (PIK3CA R88Q)
  Core: TRQLCDLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDEXRQXCXLRXFQPFLKVIE

SEQ ID NO: 27752 - protein, 24 aa, Artificial Sequence
  Description of Artificial Sequence: Synthetic peptide
  Seed: EEFFDETRQLCDLRLFQPFLKVIE (PIK3CA R88Q)
  Core: RQLCDLRLF
  misc_feature (8)..(8): Xaa can be Ala, Cys, Glu, Phe, His, Ile, Lys, Leu, Met, Asn, Pro, Gln, Arg, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFFDETXQLXDXRLXQPFLKVIE

SEQ ID NO: 27753 - protein, 15 aa, Artificial Sequence
  Description of Artificial Sequence: Synthetic peptide
  Seed: EFFDETRQLCDLRLF (PIK3CA R88Q)
  Core: FFDETRQLC
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXFDXTXQLXDLRLF

SEQ ID NO: 27754 - protein, 15 aa, Artificial Sequence
  Description of Artificial Sequence: Synthetic peptide
  Seed: EFFDETRQLCDLRLF (PIK3CA R88Q)
  Core: TRQLCDLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFFDEXRQXCXLRXF

SEQ ID NO: 27755 - protein, 15 aa, Artificial Sequence
  Description of Artificial Sequence: Synthetic peptide
  Seed: EFFDETRQLCDLRLF (PIK3CA R88Q)
  Core: RQLCDLRLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFFDETXQLXDXRLX

SEQ ID NO: 27756 - protein, 16 aa, Artificial Sequence
  Description of Artificial Sequence: Synthetic peptide
  Seed: EFFDETRQLCDLRLFQ (PIK3CA R88Q)
  Core: FFDETRQLC
  misc_feature (2)..(2): Xaa can be Phe, Ile, Lys, Leu, Met, Arg, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, or Va l
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXFDXTXQLXDLRLFQ

SEQ ID NO: 27757 - protein, 16 aa, Artificial Sequence
  Description of Artificial Sequence: Synthetic peptide
  Seed: EFFDETRQLCDLRLFQ (PIK3CA R88Q)
  Core: TRQLCDLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFFDEXRQXCXLRXFQ

SEQ ID NO: 27758 - protein, 16 aa, Artificial Sequence
  Description of Artificial Sequence: Synthetic peptide
  Seed: EFFDETRQLCDLRLFQ (PIK3CA R88Q)
  Core: RQLCDLRLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFFDETXQLXDXRLXQ

SEQ ID NO: 27759 - protein, 17 aa, Artificial Sequence
  Description of Artificial Sequence: Synthetic peptide
  Seed: EFFDETRQLCDLRLFQP (PIK3CA R88Q)
  Core: TRQLCDLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFFDEXRQXCXLRXFQP

SEQ ID NO: 27760 - protein, 17 aa, Artificial Sequence
  Description of Artificial Sequence: Synthetic peptide
  Seed: EFFDETRQLCDLRLFQP (PIK3CA R88Q)
  Core: RQLCDLRLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFFDETXQLXDXRLXQP

SEQ ID NO: 27761 - protein, 18 aa, Artificial Sequence
  Description of Artificial Sequence: Synthetic peptide
  Seed: EFFDETRQLCDLRLFQPF (PIK3CA R88Q)
  Core: TRQLCDLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFFDEXRQXCXLRXFQPF

SEQ ID NO: 27762 - protein, 18 aa, Artificial Sequence
  Description of Artificial Sequence: Synthetic peptide
  Seed: EFFDETRQLCDLRLFQPF (PIK3CA R88Q)
  Core: RQLCDLRLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFFDETXQLXDXRLXQPF

SEQ ID NO: 27763 - protein, 19 aa, Artificial Sequence
  Description of Artificial Sequence: Synthetic peptide
  Seed: EFFDETRQLCDLRLFQPFL (PIK3CA R88Q)
  Core: TRQLCDLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFFDEXRQXCXLRXFQPFL

SEQ ID NO: 27764 - protein, 19 aa, Artificial Sequence
  Description of Artificial Sequence: Synthetic peptide
  Seed: EFFDETRQLCDLRLFQPFL (PIK3CA R88Q)
  Core: RQLCDLRLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFFDETXQLXDXRLXQPFL

SEQ ID NO: 27765 - protein, 20 aa, Artificial Sequence
  Description of Artificial Sequence: Synthetic peptide
  Seed: EFFDETRQLCDLRLFQPFLK (PIK3CA R88Q)
  Core: TRQLCDLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFFDEXRQXCXLRXFQPFLK

SEQ ID NO: 27766 - protein, 20 aa, Artificial Sequence
  Description of Artificial Sequence: Synthetic peptide
  Seed: EFFDETRQLCDLRLFQPFLK (PIK3CA R88Q)
  Core: RQLCDLRLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFFDETXQLXDXRLXQPFLK

SEQ ID NO: 27767 - protein, 21 aa, Artificial Sequence
  Description of Artificial Sequence: Synthetic peptide
  Seed: EFFDETRQLCDLRLFQPFLKV (PIK3CA R88Q)
  Core: TRQLCDLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFFDEXRQXCXLRXFQPFLKV

SEQ ID NO: 27768 - protein, 21 aa, Artificial Sequence
  Description of Artificial Sequence: Synthetic peptide
  Seed: EFFDETRQLCDLRLFQPFLKV (PIK3CA R88Q)
  Core: RQLCDLRLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFFDETXQLXDXRLXQPFLKV

SEQ ID NO: 27769 - protein, 22 aa, Artificial Sequence
  Description of Artificial Sequence: Synthetic peptide
  Seed: EFFDETRQLCDLRLFQPFLKVI (PIK3CA R88Q)
  Core: TRQLCDLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFFDEXRQXCXLRXFQPFLKVI

SEQ ID NO: 27770 - protein, 22 aa, Artificial Sequence
  Description of Artificial Sequence: Synthetic peptide
  Seed: EFFDETRQLCDLRLFQPFLKVI (PIK3CA R88Q)
  Core: RQLCDLRLF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFFDETXQLXDXRLXQPFLKVI

SEQ ID NO: 27771 - protein, 23 aa, Artificial Sequence
  Description of Artificial Sequence: Synthetic peptide
  Seed: EFFDETRQLCDLRLFQPFLKVIE (PIK3CA R88Q)
  Core: TRQLCDLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFFDEXRQXCXLRXFQPFLKVIE

SEQ ID NO: 27772 - protein, 23 aa, Artificial Sequence
  Description of Artificial Sequence: Synthetic peptide
  Seed: EFFDETRQLCDLRLFQPFLKVIE (PIK3CA R88Q)
  Core: RQLCDLRLF
  misc_feature (7)..(7): Xaa can be Ala, Cys, Glu, Phe, His, Ile, Lys, Leu, Met, Asn, Pro, Gln, Arg, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFFDETXQLXDXRLXQPFLKVIE

SEQ ID NO: 27773 - protein, 16 aa, Artificial Sequence
  Description of Artificial Sequence: Synthetic peptide
  Seed: EREEFFDETRQLCDLR (PIK3CA R88Q)
  Core: FFDETRQLC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EREEXFDXTXQLXDLR

SEQ ID NO: 27774 - protein, 17 aa, Artificial Sequence
  Description of Artificial Sequence: Synthetic peptide
  Seed: EREEFFDETRQLCDLRL (PIK3CA R88Q)
  Core: FFDETRQLC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EREEXFDXTXQLXDLRL

SEQ ID NO: 27775 - protein, 19 aa, Artificial Sequence
  Description of Artificial Sequence: Synthetic peptide
  Seed: EREEFFDETRQLCDLRLFQ (PIK3CA R88Q)
  Core: FFDETRQLC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EREEXFDXTXQLXDLRLFQ

SEQ ID NO: 27776 - protein, 19 aa, Artificial Sequence
  Description of Artificial Sequence: Synthetic peptide
  Seed: EREEFFDETRQLCDLRLFQ (PIK3CA R88Q)
  Core: TRQLCDLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDEXRQXCXLRXFQ

SEQ ID NO: 27777 - protein, 20 aa, Artificial Sequence
  Description of Artificial Sequence: Synthetic peptide
  Seed: EREEFFDETRQLCDLRLFQP (PIK3CA R88Q)
  Core: FFDETRQLC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EREEXFDXTXQLXDLRLFQP

SEQ ID NO: 27778 - protein, 20 aa, Artificial Sequence
  Description of Artificial Sequence: Synthetic peptide
  Seed: EREEFFDETRQLCDLRLFQP (PIK3CA R88Q)
  Core: TRQLCDLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDEXRQXCXLRXFQP

SEQ ID NO: 27779 - protein, 20 aa, Artificial Sequence
  Description of Artificial Sequence: Synthetic peptide
  Seed: EREEFFDETRQLCDLRLFQP (PIK3CA R88Q)
  Core: RQLCDLRLF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDETXQLXDXRLXQP

SEQ ID NO: 27780 - protein, 21 aa, Artificial Sequence
  Description of Artificial Sequence: Synthetic peptide
  Seed: EREEFFDETRQLCDLRLFQPF (PIK3CA R88Q)
  Core: FFDETRQLC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EREEXFDXTXQLXDLRLFQPF

SEQ ID NO: 27781 - protein, 21 aa, Artificial Sequence
  Description of Artificial Sequence: Synthetic peptide
  Seed: EREEFFDETRQLCDLRLFQPF (PIK3CA R88Q)
  Core: TRQLCDLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDEXRQXCXLRXFQPF

SEQ ID NO: 27782 - protein, 21 aa, Artificial Sequence
  Description of Artificial Sequence: Synthetic peptide
  Seed: EREEFFDETRQLCDLRLFQPF (PIK3CA R88Q)
  Core: RQLCDLRLF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDETXQLXDXRLXQPF

SEQ ID NO: 27783 - protein, 22 aa, Artificial Sequence
  Description of Artificial Sequence: Synthetic peptide
  Seed: EREEFFDETRQLCDLRLFQPFL (PIK3CA R88Q)
  Core: FFDETRQLC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EREEXFDXTXQLXDLRLFQPFL

SEQ ID NO: 27784 - protein, 22 aa, Artificial Sequence
  Description of Artificial Sequence: Synthetic peptide
  Seed: EREEFFDETRQLCDLRLFQPFL (PIK3CA R88Q)
  Core: TRQLCDLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDEXRQXCXLRXFQPFL

SEQ ID NO: 27785 - protein, 22 aa, Artificial Sequence
  Description of Artificial Sequence: Synthetic peptide
  Seed: EREEFFDETRQLCDLRLFQPFL (PIK3CA R88Q)
  Core: RQLCDLRLF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDETXQLXDXRLXQPFL

SEQ ID NO: 27786 - protein, 23 aa, Artificial Sequence
  Description of Artificial Sequence: Synthetic peptide
  Seed: EREEFFDETRQLCDLRLFQPFLK (PIK3CA R88Q)
  Core: FFDETRQLC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EREEXFDXTXQLXDLRLFQPFLK

SEQ ID NO: 27787 - protein, 23 aa, Artificial Sequence
  Description of Artificial Sequence: Synthetic peptide
  Seed: EREEFFDETRQLCDLRLFQPFLK (PIK3CA R88Q)
  Core: TRQLCDLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDEXRQXCXLRXFQPFLK

SEQ ID NO: 27788 - protein, 23 aa, Artificial Sequence
  Description of Artificial Sequence: Synthetic peptide
  Seed: EREEFFDETRQLCDLRLFQPFLK (PIK3CA R88Q)
  Core: RQLCDLRLF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDETXQLXDXRLXQPFLK

SEQ ID NO: 27789 - protein, 24 aa, Artificial Sequence
  Description of Artificial Sequence: Synthetic peptide
  Seed: EREEFFDETRQLCDLRLFQPFLKV (PIK3CA R88Q)
  Core: FFDETRQLC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EREEXFDXTXQLXDLRLFQPFLKV

SEQ ID NO: 27790 - protein, 24 aa, Artificial Sequence
  Description of Artificial Sequence: Synthetic peptide
  Seed: EREEFFDETRQLCDLRLFQPFLKV (PIK3CA R88Q)
  Core: TRQLCDLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDEXRQXCXLRXFQPFLKV

SEQ ID NO: 27791 - protein, 24 aa, Artificial Sequence
  Description of Artificial Sequence: Synthetic peptide
  Seed: EREEFFDETRQLCDLRLFQPFLKV (PIK3CA R88Q)
  Core: RQLCDLRLF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDETXQLXDXRLXQPFLKV

SEQ ID NO: 27792 - protein, 25 aa, Artificial Sequence
  Description of Artificial Sequence: Synthetic peptide
  Seed: EREEFFDETRQLCDLRLFQPFLKVI (PIK3CA R88Q)
  Core: FFDETRQLC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EREEXFDXTXQLXDLRLFQPFLKVI

SEQ ID NO: 27793 - protein, 25 aa, Artificial Sequence
  Description of Artificial Sequence: Synthetic peptide
  Seed: EREEFFDETRQLCDLRLFQPFLKVI (PIK3CA R88Q)
  Core: TRQLCDLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDEXRQXCXLRXFQPFLKVI

SEQ ID NO: 27794 - protein, 25 aa, Artificial Sequence
  Description of Artificial Sequence: Synthetic peptide
  Seed: EREEFFDETRQLCDLRLFQPFLKVI (PIK3CA R88Q)
  Core: RQLCDLRLF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EREEFFDETXQLXDXRLXQPFLKVI

SEQ ID NO: 27795 - protein, 14 aa, Artificial Sequence
  Description of Artificial Sequence: Synthetic peptide
  Seed: ETRQLCDLRLFQPF (PIK3CA R88Q)
  Core: TRQLCDLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXRQXCXLRXFQPF

SEQ ID NO: 27796 - protein, 14 aa, Artificial Sequence
  Description of Artificial Sequence: Synthetic peptide
  Seed: ETRQLCDLRLFQPF (PIK3CA R88Q)
  Core: RQLCDLRLF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ETXQLXDXRLXQPF

SEQ ID NO: 27797 - protein, 15 aa, Artificial Sequence
  Description of Artificial Sequence: Synthetic peptide
  Seed: ETRQLCDLRLFQPFL (PIK3CA R88Q)
  Core: TRQLCDLRL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXRQXCXLRXFQPFL

SEQ ID NO: 27798 - protein, 15 aa, Artificial Sequence
  Description of Artificial Sequence: Synthetic peptide
  Seed: ETRQLCDLRLFQPFL (PIK3CA R88Q)
  Core: RQLCDLRLF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ETXQLXDXRLXQPFL

SEQ ID NO: 27799 - protein, 16 aa, Artificial Sequence
  Description of Artificial Sequence: Synthetic peptide
  Seed: ETRQLCDLRLFQPFLK (PIK3CA R88Q)
  Core: RQLCDLRLF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ETXQLXDXRLXQPFLK

SEQ ID NO: 27800 - protein, 17 aa, Artificial Sequence
  Description of Artificial Sequence: Synthetic peptide
  Seed: ETRQLCDLRLFQPFLKV (PIK3CA R88Q)
  Core: RQLCDLRLF
  misc_feature (3)..(3): Xaa can be Phe, His, Ile, Lys, Leu, Met, Gln, Arg, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Phe, Gly, Ile, Leu, Met, Asn, Pro, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ETXQLXDXRLXQPFLKV

SEQ ID NO: 27801 - protein, 14 aa, Artificial Sequence
  Description of Artificial Sequence: Synthetic peptide
  Seed: FDETRQLCDLRLFQ (PIK3CA R88Q)
  Core: TRQLCDLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FDEXRQXCXLRXFQ

SEQ ID NO: 27802 - protein, 15 aa, Artificial Sequence
  Description of Artificial Sequence: Synthetic peptide
  Seed: FDETRQLCDLRLFQP (PIK3CA R88Q)
  Core: TRQLCDLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FDEXRQXCXLRXFQP

SEQ ID NO: 27803 - protein, 15 aa, Artificial Sequence
  Description of Artificial Sequence: Synthetic peptide
  Seed: FDETRQLCDLRLFQP (PIK3CA R88Q)
  Core: RQLCDLRLF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FDETXQLXDXRLXQP

SEQ ID NO: 27804 - protein, 16 aa, Artificial Sequence
  Description of Artificial Sequence: Synthetic peptide
  Seed: FDETRQLCDLRLFQPF (PIK3CA R88Q)
  Core: TRQLCDLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FDEXRQXCXLRXFQPF

SEQ ID NO: 27805 - protein, 16 aa, Artificial Sequence
  Description of Artificial Sequence: Synthetic peptide
  Seed: FDETRQLCDLRLFQPF (PIK3CA R88Q)
  Core: RQLCDLRLF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FDETXQLXDXRLXQPF

SEQ ID NO: 27806 - protein, 17 aa, Artificial Sequence
  Description of Artificial Sequence: Synthetic peptide
  Seed: FDETRQLCDLRLFQPFL (PIK3CA R88Q)
  Core: TRQLCDLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FDEXRQXCXLRXFQPFL

SEQ ID NO: 27807 - protein, 17 aa, Artificial Sequence
  Description of Artificial Sequence: Synthetic peptide
  Seed: FDETRQLCDLRLFQPFL (PIK3CA R88Q)
  Core: RQLCDLRLF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FDETXQLXDXRLXQPFL

SEQ ID NO: 27808 - protein, 18 aa, Artificial Sequence
  Description of Artificial Sequence: Synthetic peptide
  Seed: FDETRQLCDLRLFQPFLK (PIK3CA R88Q)
  Core: TRQLCDLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FDEXRQXCXLRXFQPFLK

SEQ ID NO: 27809 - protein, 18 aa, Artificial Sequence
  Description of Artificial Sequence: Synthetic peptide
  Seed: FDETRQLCDLRLFQPFLK (PIK3CA R88Q)
  Core: RQLCDLRLF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FDETXQLXDXRLXQPFLK

SEQ ID NO: 27810 - protein, 19 aa, Artificial Sequence
  Description of Artificial Sequence: Synthetic peptide
  Seed: FDETRQLCDLRLFQPFLKV (PIK3CA R88Q)
  Core: TRQLCDLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FDEXRQXCXLRXFQPFLKV

SEQ ID NO: 27811 - protein, 19 aa, Artificial Sequence
  Description of Artificial Sequence: Synthetic peptide
  Seed: FDETRQLCDLRLFQPFLKV (PIK3CA R88Q)
  Core: RQLCDLRLF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FDETXQLXDXRLXQPFLKV

SEQ ID NO: 27812 - protein, 20 aa, Artificial Sequence
  Description of Artificial Sequence: Synthetic peptide
  Seed: FDETRQLCDLRLFQPFLKVI (PIK3CA R88Q)
  Core: TRQLCDLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FDEXRQXCXLRXFQPFLKVI

SEQ ID NO: 27813 - protein, 20 aa, Artificial Sequence
  Description of Artificial Sequence: Synthetic peptide
  Seed: FDETRQLCDLRLFQPFLKVI (PIK3CA R88Q)
  Core: RQLCDLRLF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FDETXQLXDXRLXQPFLKVI

SEQ ID NO: 27814 - protein, 21 aa, Artificial Sequence
  Description of Artificial Sequence: Synthetic peptide
  Seed: FDETRQLCDLRLFQPFLKVIE (PIK3CA R88Q)
  Core: RQLCDLRLF
  misc_feature (5)..(5): Xaa can be Cys, Phe, His, Ile, Lys, Leu, Met, Asn, Gln, Arg, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FDETXQLXDXRLXQPFLKVIE

SEQ ID NO: 27815 - protein, 14 aa, Artificial Sequence
  Description of Artificial Sequence: Synthetic peptide
  Seed: FFDETRQLCDLRLF (PIK3CA R88Q)
  Core: TRQLCDLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FFDEXRQXCXLRXF

SEQ ID NO: 27816 - protein, 15 aa, Artificial Sequence
  Description of Artificial Sequence: Synthetic peptide
  Seed: FFDETRQLCDLRLFQ (PIK3CA R88Q)
  Core: TRQLCDLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FFDEXRQXCXLRXFQ

SEQ ID NO: 27817 - protein, 15 aa, Artificial Sequence
  Description of Artificial Sequence: Synthetic peptide
  Seed: FFDETRQLCDLRLFQ (PIK3CA R88Q)
  Core: RQLCDLRLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FFDETXQLXDXRLXQ

SEQ ID NO: 27818 - protein, 16 aa, Artificial Sequence
  Description of Artificial Sequence: Synthetic peptide
  Seed: FFDETRQLCDLRLFQP (PIK3CA R88Q)
  Core: TRQLCDLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FFDEXRQXCXLRXFQP

SEQ ID NO: 27819 - protein, 16 aa, Artificial Sequence
  Description of Artificial Sequence: Synthetic peptide
  Seed: FFDETRQLCDLRLFQP (PIK3CA R88Q)
  Core: RQLCDLRLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FFDETXQLXDXRLXQP

SEQ ID NO: 27820 - protein, 17 aa, Artificial Sequence
  Description of Artificial Sequence: Synthetic peptide
  Seed: FFDETRQLCDLRLFQPF (PIK3CA R88Q)
  Core: TRQLCDLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FFDEXRQXCXLRXFQPF

SEQ ID NO: 27821 - protein, 17 aa, Artificial Sequence
  Description of Artificial Sequence: Synthetic peptide
  Seed: FFDETRQLCDLRLFQPF (PIK3CA R88Q)
  Core: RQLCDLRLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FFDETXQLXDXRLXQPF

SEQ ID NO: 27822 - protein, 18 aa, Artificial Sequence
  Description of Artificial Sequence: Synthetic peptide
  Seed: FFDETRQLCDLRLFQPFL (PIK3CA R88Q)
  Core: TRQLCDLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FFDEXRQXCXLRXFQPFL

SEQ ID NO: 27823 - protein, 18 aa, Artificial Sequence
  Description of Artificial Sequence: Synthetic peptide
  Seed: FFDETRQLCDLRLFQPFL (PIK3CA R88Q)
  Core: RQLCDLRLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FFDETXQLXDXRLXQPFL

SEQ ID NO: 27824 - protein, 19 aa, Artificial Sequence
  Description of Artificial Sequence: Synthetic peptide
  Seed: FFDETRQLCDLRLFQPFLK (PIK3CA R88Q)
  Core: TRQLCDLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FFDEXRQXCXLRXFQPFLK

SEQ ID NO: 27825 - protein, 19 aa, Artificial Sequence
  Description of Artificial Sequence: Synthetic peptide
  Seed: FFDETRQLCDLRLFQPFLK (PIK3CA R88Q)
  Core: RQLCDLRLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FFDETXQLXDXRLXQPFLK

SEQ ID NO: 27826 - protein, 20 aa, Artificial Sequence
  Description of Artificial Sequence: Synthetic peptide
  Seed: FFDETRQLCDLRLFQPFLKV (PIK3CA R88Q)
  Core: TRQLCDLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FFDEXRQXCXLRXFQPFLKV

SEQ ID NO: 27827 - protein, 20 aa, Artificial Sequence
  Description of Artificial Sequence: Synthetic peptide
  Seed: FFDETRQLCDLRLFQPFLKV (PIK3CA R88Q)
  Core: RQLCDLRLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FFDETXQLXDXRLXQPFLKV

SEQ ID NO: 27828 - protein, 21 aa, Artificial Sequence
  Description of Artificial Sequence: Synthetic peptide
  Seed: FFDETRQLCDLRLFQPFLKVI (PIK3CA R88Q)
  Core: TRQLCDLRL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FFDEXRQXCXLRXFQPFLKVI

SEQ ID NO: 27829 - protein, 21 aa, Artificial Sequence
  Description of Artificial Sequence: Synthetic peptide
  Seed: FFDETRQLCDLRLFQPFLKVI (PIK3CA R88Q)
  Core: RQLCDLRLF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FFDETXQLXDXRLXQPFLKVI

SEQ ID NO: 27830 - protein, 22 aa, Artificial Sequence
  Description of Artificial Sequence: Synthetic peptide
  Seed: FFDETRQLCDLRLFQPFLKVIE (PIK3CA R88Q)
  Core: RQLCDLRLF
  misc_feature (6)..(6): Xaa can be Cys, Glu, Phe, His, Ile, Lys, Leu, Met, Asn, Pro, Gln, Arg, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FFDETXQLXDXRLXQPFLKVIE

SEQ ID NO: 27831 - protein, 25 aa, Artificial Sequence
  Description of Artificial Sequence: Synthetic peptide
  Seed: FVSVTQEAEREEFFDETRQLCDLRL (PIK3CA R88Q)
  Core: FFDETRQLC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
FVSVTQEAEREEXFDXTXQLXDLRL

SEQ ID NO: 27832 - protein, 25 aa, Artificial Sequence
  Description of Artificial Sequence: Synthetic peptide
  Seed: IFVSVTQEAEREEFFDETRQLCDLR (PIK3CA R88Q)
  Core: FFDETRQLC
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IFVSVTQEAEREEXFDXTXQLXDLR

SEQ ID NO: 27833 - protein, 20 aa, Artificial Sequence
  Description of Artificial Sequence: Synthetic peptide
  Seed: QEAEREEFFDETRQLCDLRL (PIK3CA R88Q)
  Core: FFDETRQLC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEXFDXTXQLXDLRL

SEQ ID NO: 27834 - protein, 21 aa, Artificial Sequence
  Description of Artificial Sequence: Synthetic peptide
  Seed: QEAEREEFFDETRQLCDLRLF (PIK3CA R88Q)
  Core: FFDETRQLC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEXFDXTXQLXDLRLF

SEQ ID NO: 27835 - protein, 22 aa, Artificial Sequence
  Description of Artificial Sequence: Synthetic peptide
  Seed: QEAEREEFFDETRQLCDLRLFQ (PIK3CA R88Q)
  Core: FFDETRQLC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEXFDXTXQLXDLRLFQ

SEQ ID NO: 27836 - protein, 22 aa, Artificial Sequence
  Description of Artificial Sequence: Synthetic peptide
  Seed: QEAEREEFFDETRQLCDLRLFQ (PIK3CA R88Q)
  Core: TRQLCDLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEFFDEXRQXCXLRXFQ

SEQ ID NO: 27837 - protein, 23 aa, Artificial Sequence
  Description of Artificial Sequence: Synthetic peptide
  Seed: QEAEREEFFDETRQLCDLRLFQP (PIK3CA R88Q)
  Core: FFDETRQLC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEXFDXTXQLXDLRLFQP

SEQ ID NO: 27838 - protein, 23 aa, Artificial Sequence
  Description of Artificial Sequence: Synthetic peptide
  Seed: QEAEREEFFDETRQLCDLRLFQP (PIK3CA R88Q)
  Core: TRQLCDLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEFFDEXRQXCXLRXFQP

SEQ ID NO: 27839 - protein, 23 aa, Artificial Sequence
  Description of Artificial Sequence: Synthetic peptide
  Seed: QEAEREEFFDETRQLCDLRLFQP (PIK3CA R88Q)
  Core: RQLCDLRLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Glu, Phe, Gly, His, Ile, Leu, Met, Asn, Pro, Gln, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEFFDETXQLXDXRLXQP

SEQ ID NO: 27840 - protein, 24 aa, Artificial Sequence
  Description of Artificial Sequence: Synthetic peptide
  Seed: QEAEREEFFDETRQLCDLRLFQPF (PIK3CA R88Q)
  Core: FFDETRQLC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEXFDXTXQLXDLRLFQPF

SEQ ID NO: 27841 - protein, 24 aa, Artificial Sequence
  Description of Artificial Sequence: Synthetic peptide
  Seed: QEAEREEFFDETRQLCDLRLFQPF (PIK3CA R88Q)
  Core: TRQLCDLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEFFDEXRQXCXLRXFQPF

SEQ ID NO: 27842 - protein, 24 aa, Artificial Sequence
  Description of Artificial Sequence: Synthetic peptide
  Seed: QEAEREEFFDETRQLCDLRLFQPF (PIK3CA R88Q)
  Core: RQLCDLRLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEFFDETXQLXDXRLXQPF

SEQ ID NO: 27843 - protein, 25 aa, Artificial Sequence
  Description of Artificial Sequence: Synthetic peptide
  Seed: QEAEREEFFDETRQLCDLRLFQPFL (PIK3CA R88Q)
  Core: FFDETRQLC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEXFDXTXQLXDLRLFQPFL

SEQ ID NO: 27844 - protein, 25 aa, Artificial Sequence
  Description of Artificial Sequence: Synthetic peptide
  Seed: QEAEREEFFDETRQLCDLRLFQPFL (PIK3CA R88Q)
  Core: TRQLCDLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEFFDEXRQXCXLRXFQPFL

SEQ ID NO: 27845 - protein, 25 aa, Artificial Sequence
  Description of Artificial Sequence: Synthetic peptide
  Seed: QEAEREEFFDETRQLCDLRLFQPFL (PIK3CA R88Q)
  Core: RQLCDLRLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QEAEREEFFDETXQLXDXRLXQPFL

SEQ ID NO: 27846 - protein, 15 aa, Artificial Sequence
  Description of Artificial Sequence: Synthetic peptide
  Seed: REEFFDETRQLCDLR (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLR

SEQ ID NO: 27847 - protein, 16 aa, Artificial Sequence
  Description of Artificial Sequence: Synthetic peptide
  Seed: REEFFDETRQLCDLRL (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLRL

SEQ ID NO: 27848 - protein, 17 aa, Artificial Sequence
  Description of Artificial Sequence: Synthetic peptide
  Seed: REEFFDETRQLCDLRLF (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLRLF

SEQ ID NO: 27849 - protein, 19 aa, Artificial Sequence
  Description of Artificial Sequence: Synthetic peptide
  Seed: REEFFDETRQLCDLRLFQP (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLRLFQP

SEQ ID NO: 27850 - protein, 19 aa, Artificial Sequence
  Description of Artificial Sequence: Synthetic peptide
  Seed: REEFFDETRQLCDLRLFQP (PIK3CA R88Q)
  Core: TRQLCDLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDEXRQXCXLRXFQP

SEQ ID NO: 27851 - protein, 19 aa, Artificial Sequence
  Description of Artificial Sequence: Synthetic peptide
  Seed: REEFFDETRQLCDLRLFQP (PIK3CA R88Q)
  Core: RQLCDLRLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDETXQLXDXRLXQP

SEQ ID NO: 27852 - protein, 20 aa, Artificial Sequence
  Description of Artificial Sequence: Synthetic peptide
  Seed: REEFFDETRQLCDLRLFQPF (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLRLFQPF

SEQ ID NO: 27853 - protein, 20 aa, Artificial Sequence
  Description of Artificial Sequence: Synthetic peptide
  Seed: REEFFDETRQLCDLRLFQPF (PIK3CA R88Q)
  Core: TRQLCDLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDEXRQXCXLRXFQPF

SEQ ID NO: 27854 - protein, 20 aa, Artificial Sequence
  Description of Artificial Sequence: Synthetic peptide
  Seed: REEFFDETRQLCDLRLFQPF (PIK3CA R88Q)
  Core: RQLCDLRLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDETXQLXDXRLXQPF

SEQ ID NO: 27855 - protein, 21 aa, Artificial Sequence
  Description of Artificial Sequence: Synthetic peptide
  Seed: REEFFDETRQLCDLRLFQPFL (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLRLFQPFL

SEQ ID NO: 27856 - protein, 21 aa, Artificial Sequence
  Description of Artificial Sequence: Synthetic peptide
  Seed: REEFFDETRQLCDLRLFQPFL (PIK3CA R88Q)
  Core: TRQLCDLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDEXRQXCXLRXFQPFL

SEQ ID NO: 27857 - protein, 21 aa, Artificial Sequence
  Description of Artificial Sequence: Synthetic peptide
  Seed: REEFFDETRQLCDLRLFQPFL (PIK3CA R88Q)
  Core: RQLCDLRLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDETXQLXDXRLXQPFL

SEQ ID NO: 27858 - protein, 22 aa, Artificial Sequence
  Description of Artificial Sequence: Synthetic peptide
  Seed: REEFFDETRQLCDLRLFQPFLK (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLRLFQPFLK

SEQ ID NO: 27859 - protein, 22 aa, Artificial Sequence
  Description of Artificial Sequence: Synthetic peptide
  Seed: REEFFDETRQLCDLRLFQPFLK (PIK3CA R88Q)
  Core: TRQLCDLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDEXRQXCXLRXFQPFLK

SEQ ID NO: 27860 - protein, 22 aa, Artificial Sequence
  Description of Artificial Sequence: Synthetic peptide
  Seed: REEFFDETRQLCDLRLFQPFLK (PIK3CA R88Q)
  Core: RQLCDLRLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDETXQLXDXRLXQPFLK

SEQ ID NO: 27861 - protein, 23 aa, Artificial Sequence
  Description of Artificial Sequence: Synthetic peptide
  Seed: REEFFDETRQLCDLRLFQPFLKV (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLRLFQPFLKV

SEQ ID NO: 27862 - protein, 23 aa, Artificial Sequence
  Description of Artificial Sequence: Synthetic peptide
  Seed: REEFFDETRQLCDLRLFQPFLKV (PIK3CA R88Q)
  Core: TRQLCDLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDEXRQXCXLRXFQPFLKV

SEQ ID NO: 27863 - protein, 23 aa, Artificial Sequence
  Description of Artificial Sequence: Synthetic peptide
  Seed: REEFFDETRQLCDLRLFQPFLKV (PIK3CA R88Q)
  Core: RQLCDLRLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDETXQLXDXRLXQPFLKV

SEQ ID NO: 27864 - protein, 24 aa, Artificial Sequence
  Description of Artificial Sequence: Synthetic peptide
  Seed: REEFFDETRQLCDLRLFQPFLKVI (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLRLFQPFLKVI

SEQ ID NO: 27865 - protein, 24 aa, Artificial Sequence
  Description of Artificial Sequence: Synthetic peptide
  Seed: REEFFDETRQLCDLRLFQPFLKVI (PIK3CA R88Q)
  Core: TRQLCDLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDEXRQXCXLRXFQPFLKVI

SEQ ID NO: 27866 - protein, 24 aa, Artificial Sequence
  Description of Artificial Sequence: Synthetic peptide
  Seed: REEFFDETRQLCDLRLFQPFLKVI (PIK3CA R88Q)
  Core: RQLCDLRLF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDETXQLXDXRLXQPFLKVI

SEQ ID NO: 27867 - protein, 25 aa, Artificial Sequence
  Description of Artificial Sequence: Synthetic peptide
  Seed: REEFFDETRQLCDLRLFQPFLKVIE (PIK3CA R88Q)
  Core: FFDETRQLC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
REEXFDXTXQLXDLRLFQPFLKVIE

SEQ ID NO: 27868 - protein, 25 aa, Artificial Sequence
  Description of Artificial Sequence: Synthetic peptide
  Seed: REEFFDETRQLCDLRLFQPFLKVIE (PIK3CA R88Q)
  Core: TRQLCDLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDEXRQXCXLRXFQPFLKVIE

SEQ ID NO: 27869 - protein, 25 aa, Artificial Sequence
  Description of Artificial Sequence: Synthetic peptide
  Seed: REEFFDETRQLCDLRLFQPFLKVIE (PIK3CA R88Q)
  Core: RQLCDLRLF
  misc_feature (9)..(9): Xaa can be Cys, Glu, Phe, His, Ile, Lys, Leu, Met, Asn, Pro, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
REEFFDETXQLXDXRLXQPFLKVIE

SEQ ID NO: 27870 - protein, 24 aa, Artificial Sequence
  Description of Artificial Sequence: Synthetic peptide
  Seed: SVTQEAEREEFFDETRQLCDLRLF (PIK3CA R88Q)
  Core: FFDETRQLC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SVTQEAEREEXFDXTXQLXDLRLF

SEQ ID NO: 27871 - protein, 25 aa, Artificial Sequence
  Description of Artificial Sequence: Synthetic peptide
  Seed: SVTQEAEREEFFDETRQLCDLRLFQ (PIK3CA R88Q)
  Core: FFDETRQLC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SVTQEAEREEXFDXTXQLXDLRLFQ

SEQ ID NO: 27872 - protein, 25 aa, Artificial Sequence
  Description of Artificial Sequence: Synthetic peptide
  Seed: SVTQEAEREEFFDETRQLCDLRLFQ (PIK3CA R88Q)
  Core: TRQLCDLRL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SVTQEAEREEFFDEXRQXCXLRXFQ

SEQ ID NO: 27873 - protein, 20 aa, Artificial Sequence
  Description of Artificial Sequence: Synthetic peptide
  Seed: TQEAEREEFFDETRQLCDLR (PIK3CA R88Q)
  Core: FFDETRQLC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQEAEREEXFDXTXQLXDLR

SEQ ID NO: 27874 - protein, 22 aa, Artificial Sequence
  Description of Artificial Sequence: Synthetic peptide
  Seed: TQEAEREEFFDETRQLCDLRLF (PIK3CA R88Q)
  Core: FFDETRQLC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQEAEREEXFDXTXQLXDLRLF

SEQ ID NO: 27875 - protein, 23 aa, Artificial Sequence
  Description of Artificial Sequence: Synthetic peptide
  Seed: TQEAEREEFFDETRQLCDLRLFQ (PIK3CA R88Q)
  Core: FFDETRQLC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQEAEREEXFDXTXQLXDLRLFQ

SEQ ID NO: 27876 - protein, 23 aa, Artificial Sequence
  Description of Artificial Sequence: Synthetic peptide
  Seed: TQEAEREEFFDETRQLCDLRLFQ (PIK3CA R88Q)
  Core: TRQLCDLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TQEAEREEFFDEXRQXCXLRXFQ

SEQ ID NO: 27877 - protein, 24 aa, Artificial Sequence
  Description of Artificial Sequence: Synthetic peptide
  Seed: TQEAEREEFFDETRQLCDLRLFQP (PIK3CA R88Q)
  Core: FFDETRQLC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQEAEREEXFDXTXQLXDLRLFQP

SEQ ID NO: 27878 - protein, 24 aa, Artificial Sequence
  Description of Artificial Sequence: Synthetic peptide
  Seed: TQEAEREEFFDETRQLCDLRLFQP (PIK3CA R88Q)
  Core: TRQLCDLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TQEAEREEFFDEXRQXCXLRXFQP

SEQ ID NO: 27879 - protein, 25 aa, Artificial Sequence
  Description of Artificial Sequence: Synthetic peptide
  Seed: TQEAEREEFFDETRQLCDLRLFQPF (PIK3CA R88Q)
  Core: FFDETRQLC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQEAEREEXFDXTXQLXDLRLFQPF

SEQ ID NO: 27880 - protein, 25 aa, Artificial Sequence
  Description of Artificial Sequence: Synthetic peptide
  Seed: TQEAEREEFFDETRQLCDLRLFQPF (PIK3CA R88Q)
  Core: TRQLCDLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TQEAEREEFFDEXRQXCXLRXFQPF

SEQ ID NO: 27881 - protein, 25 aa, Artificial Sequence
  Description of Artificial Sequence: Synthetic peptide
  Seed: TQEAEREEFFDETRQLCDLRLFQPF (PIK3CA R88Q)
  Core: RQLCDLRLF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TQEAEREEFFDETXQLXDXRLXQPF

SEQ ID NO: 27882 - protein, 13 aa, Artificial Sequence
  Description of Artificial Sequence: Synthetic peptide
  Seed: TRQLCDLRLFQPF (PIK3CA R88Q)
  Core: RQLCDLRLF
  misc_feature (2)..(2): Xaa can be Ala, Cys, Phe, His, Ile, Lys, Leu, Met, Gln, Arg, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXQLXDXRLXQPF

SEQ ID NO: 27883 - protein, 14 aa, Artificial Sequence
  Description of Artificial Sequence: Synthetic peptide
  Seed: TRQLCDLRLFQPFL (PIK3CA R88Q)
  Core: RQLCDLRLF
  misc_feature (2)..(2): Xaa can be Ala, Cys, Glu, Phe, His, Ile, Lys, Leu, Met, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXQLXDXRLXQPFL

SEQ ID NO: 27884 - protein, 25 aa, Artificial Sequence
  Description of Artificial Sequence: Synthetic peptide
  Seed: VSVTQEAEREEFFDETRQLCDLRLF (PIK3CA R88Q)
  Core: FFDETRQLC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSVTQEAEREEXFDXTXQLXDLRLF

SEQ ID NO: 27885 - protein, 23 aa, Artificial Sequence
  Description of Artificial Sequence: Synthetic peptide
  Seed: VTQEAEREEFFDETRQLCDLRLF (PIK3CA R88Q)
  Core: FFDETRQLC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTQEAEREEXFDXTXQLXDLRLF

SEQ ID NO: 27886 - protein, 24 aa, Artificial Sequence
  Description of Artificial Sequence: Synthetic peptide
  Seed: VTQEAEREEFFDETRQLCDLRLFQ (PIK3CA R88Q)
  Core: FFDETRQLC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTQEAEREEXFDXTXQLXDLRLFQ

SEQ ID NO: 27887 - protein, 24 aa, Artificial Sequence
  Description of Artificial Sequence: Synthetic peptide
  Seed: VTQEAEREEFFDETRQLCDLRLFQ (PIK3CA R88Q)
  Core: TRQLCDLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VTQEAEREEFFDEXRQXCXLRXFQ

SEQ ID NO: 27888 - protein, 25 aa, Artificial Sequence
  Description of Artificial Sequence: Synthetic peptide
  Seed: VTQEAEREEFFDETRQLCDLRLFQP (PIK3CA R88Q)
  Core: FFDETRQLC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTQEAEREEXFDXTXQLXDLRLFQP

SEQ ID NO: 27889 - protein, 25 aa, Artificial Sequence
  Description of Artificial Sequence: Synthetic peptide
  Seed: VTQEAEREEFFDETRQLCDLRLFQP (PIK3CA R88Q)
  Core: TRQLCDLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VTQEAEREEFFDEXRQXCXLRXFQP

SEQ ID NO: 27890 - protein, 16 aa, Artificial Sequence
  Description of Artificial Sequence: Synthetic peptide
  Seed: AAIHCKAGKGGTGVMI (PTEN R130G)
  Core: CKAGKGGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXGTXVMI

SEQ ID NO: 27891 - protein, 17 aa, Artificial Sequence
  Description of Artificial Sequence: Synthetic peptide
  Seed: AAIHCKAGKGGTGVMIC (PTEN R130G)
  Core: CKAGKGGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXGTXVMIC

SEQ ID NO: 27892 - protein, 19 aa, Artificial Sequence
  Description of Artificial Sequence: Synthetic peptide
  Seed: AAIHCKAGKGGTGVMICAY (PTEN R130G)
  Core: KGGTGVMIC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAIHCKAGXGGXGXMIXAY

SEQ ID NO: 27893 - protein, 20 aa, Artificial Sequence
  Description of Artificial Sequence: Synthetic peptide
  Seed: AAIHCKAGKGGTGVMICAYL (PTEN R130G)
  Core: CKAGKGGTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXGTXVMICAYL

SEQ ID NO: 27894 - protein, 20 aa, Artificial Sequence
  Description of Artificial Sequence: Synthetic peptide
  Seed: AAIHCKAGKGGTGVMICAYL (PTEN R130G)
  Core: KGGTGVMIC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAIHCKAGXGGXGXMIXAYL

SEQ ID NO: 27895 - protein, 21 aa, Artificial Sequence
  Description of Artificial Sequence: Synthetic peptide
  Seed: AAIHCKAGKGGTGVMICAYLL (PTEN R130G)
  Core: KGGTGVMIC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAIHCKAGXGGXGXMIXAYLL

SEQ ID NO: 27896 - protein, 22 aa, Artificial Sequence
  Description of Artificial Sequence: Synthetic peptide
  Seed: AAIHCKAGKGGTGVMICAYLLH (PTEN R130G)
  Core: KGGTGVMIC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAIHCKAGXGGXGXMIXAYLLH

SEQ ID NO: 27897 - protein, 23 aa, Artificial Sequence
  Description of Artificial Sequence: Synthetic peptide
  Seed: AAIHCKAGKGGTGVMICAYLLHR (PTEN R130G)
  Core: KGGTGVMIC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAIHCKAGXGGXGXMIXAYLLHR

SEQ ID NO: 27898 - protein, 24 aa, Artificial Sequence
  Description of Artificial Sequence: Synthetic peptide
  Seed: AAIHCKAGKGGTGVMICAYLLHRG (PTEN R130G)
  Core: KGGTGVMIC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAIHCKAGXGGXGXMIXAYLLHRG

SEQ ID NO: 27899 - protein, 25 aa, Artificial Sequence
  Description of Artificial Sequence: Synthetic peptide
  Seed: AAIHCKAGKGGTGVMICAYLLHRGK (PTEN R130G)
  Core: KGGTGVMIC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAIHCKAGXGGXGXMIXAYLLHRGK

SEQ ID NO: 27900 - protein, 14 aa, Artificial Sequence
  Description of Artificial Sequence: Synthetic peptide
  Seed: AGKGGTGVMICAYL (PTEN R130G)
  Core: KGGTGVMIC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXGGXGXMIXAYL

SEQ ID NO: 27901 - protein, 15 aa, Artificial Sequence
  Description of Artificial Sequence: Synthetic peptide
  Seed: AGKGGTGVMICAYLL (PTEN R130G)
  Core: KGGTGVMIC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXGGXGXMIXAYLL

SEQ ID NO: 27902 - protein, 16 aa, Artificial Sequence
  Description of Artificial Sequence: Synthetic peptide
  Seed: AGKGGTGVMICAYLLH (PTEN R130G)
  Core: KGGTGVMIC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXGGXGXMIXAYLLH

SEQ ID NO: 27903 - protein, 17 aa, Artificial Sequence
  Description of Artificial Sequence: Synthetic peptide
  Seed: AGKGGTGVMICAYLLHR (PTEN R130G)
  Core: KGGTGVMIC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXGGXGXMIXAYLLHR

SEQ ID NO: 27904 - protein, 18 aa, Artificial Sequence
  Description of Artificial Sequence: Synthetic peptide
  Seed: AGKGGTGVMICAYLLHRG (PTEN R130G)
  Core: KGGTGVMIC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Phe, Gly, His, Ile, Leu, Met, Asn, Pro, Gln, Ser, Thr, Val, Trp, or Tyr
  misc_feature (8)..(8): Xaa can be Ala, Cys, Asp, Glu, Phe, Gly, Ile, Leu, Met, Asn, Pro, Gln, Ser, Thr, Val, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXGGXGXMIXAYLLHRG

SEQ ID NO: 27905 - protein, 19 aa, Artificial Sequence
  Description of Artificial Sequence: Synthetic peptide
  Seed: AGKGGTGVMICAYLLHRGK (PTEN R130G)
  Core: KGGTGVMIC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Phe, Gly, His, Ile, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AGXGGXGXMIXAYLLHRGK

SEQ ID NO: 27906 - protein, 15 aa, Artificial Sequence
  Description of Artificial Sequence: Synthetic peptide
  Seed: AIHCKAGKGGTGVMI (PTEN R130G)
  Core: CKAGKGGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXGTXVMI

SEQ ID NO: 27907 - protein, 16 aa, Artificial Sequence
  Description of Artificial Sequence: Synthetic peptide
  Seed: AIHCKAGKGGTGVMIC (PTEN R130G)
  Core: CKAGKGGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXGTXVMIC

SEQ ID NO: 27908 - protein, 17 aa, Artificial Sequence
  Description of Artificial Sequence: Synthetic peptide
  Seed: AIHCKAGKGGTGVMICA (PTEN R130G)
  Core: CKAGKGGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXGTXVMICA

SEQ ID NO: 27909 - protein, 18 aa, Artificial Sequence
  Description of Artificial Sequence: Synthetic peptide
  Seed: AIHCKAGKGGTGVMICAY (PTEN R130G)
  Core: KGGTGVMIC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIHCKAGXGGXGXMIXAY

SEQ ID NO: 27910 - protein, 19 aa, Artificial Sequence
  Description of Artificial Sequence: Synthetic peptide
  Seed: AIHCKAGKGGTGVMICAYL (PTEN R130G)
  Core: KGGTGVMIC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIHCKAGXGGXGXMIXAYL

SEQ ID NO: 27911 - protein, 20 aa, Artificial Sequence
  Description of Artificial Sequence: Synthetic peptide
  Seed: AIHCKAGKGGTGVMICAYLL (PTEN R130G)
  Core: KGGTGVMIC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIHCKAGXGGXGXMIXAYLL

SEQ ID NO: 27912 - protein, 21 aa, Artificial Sequence
  Description of Artificial Sequence: Synthetic peptide
  Seed: AIHCKAGKGGTGVMICAYLLH (PTEN R130G)
  Core: KGGTGVMIC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIHCKAGXGGXGXMIXAYLLH

SEQ ID NO: 27913 - protein, 22 aa, Artificial Sequence
  Description of Artificial Sequence: Synthetic peptide
  Seed: AIHCKAGKGGTGVMICAYLLHR (PTEN R130G)
  Core: KGGTGVMIC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIHCKAGXGGXGXMIXAYLLHR

SEQ ID NO: 27914 - protein, 23 aa, Artificial Sequence
  Description of Artificial Sequence: Synthetic peptide
  Seed: AIHCKAGKGGTGVMICAYLLHRG (PTEN R130G)
  Core: KGGTGVMIC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIHCKAGXGGXGXMIXAYLLHRG

SEQ ID NO: 27915 - protein, 24 aa, Artificial Sequence
  Description of Artificial Sequence: Synthetic peptide
  Seed: AIHCKAGKGGTGVMICAYLLHRGK (PTEN R130G)
  Core: KGGTGVMIC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIHCKAGXGGXGXMIXAYLLHRGK

SEQ ID NO: 27916 - protein, 25 aa, Artificial Sequence
  Description of Artificial Sequence: Synthetic peptide
  Seed: AIHCKAGKGGTGVMICAYLLHRGKF (PTEN R130G)
  Core: KGGTGVMIC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIHCKAGXGGXGXMIXAYLLHRGKF

SEQ ID NO: 27917 - protein, 14 aa, Artificial Sequence
  Description of Artificial Sequence: Synthetic peptide
  Seed: CKAGKGGTGVMICA (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXA

SEQ ID NO: 27918 - protein, 15 aa, Artificial Sequence
  Description of Artificial Sequence: Synthetic peptide
  Seed: CKAGKGGTGVMICAY (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXAY

SEQ ID NO: 27919 - protein, 16 aa, Artificial Sequence
  Description of Artificial Sequence: Synthetic peptide
  Seed: CKAGKGGTGVMICAYL (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXAYL

SEQ ID NO: 27920 - protein, 17 aa, Artificial Sequence
  Description of Artificial Sequence: Synthetic peptide
  Seed: CKAGKGGTGVMICAYLL (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXAYLL

SEQ ID NO: 27921 - protein, 18 aa, Artificial Sequence
  Description of Artificial Sequence: Synthetic peptide
  Seed: CKAGKGGTGVMICAYLLH (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXAYLLH

SEQ ID NO: 27922 - protein, 19 aa, Artificial Sequence
  Description of Artificial Sequence: Synthetic peptide
  Seed: CKAGKGGTGVMICAYLLHR (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXAYLLHR

SEQ ID NO: 27923 - protein, 20 aa, Artificial Sequence
  Description of Artificial Sequence: Synthetic peptide
  Seed: CKAGKGGTGVMICAYLLHRG (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXAYLLHRG

SEQ ID NO: 27924 - protein, 21 aa, Artificial Sequence
  Description of Artificial Sequence: Synthetic peptide
  Seed: CKAGKGGTGVMICAYLLHRGK (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
CKAGXGGXGXMIXAYLLHRGK

SEQ ID NO: 27925 - protein, 22 aa, Artificial Sequence
  Description of Artificial Sequence: Synthetic peptide
  Seed: CKAGKGGTGVMICAYLLHRGKF (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Leu, Met, Asn, Pro, Gln, Arg, Ser, Thr, Val, Trp, or Tyr
CKAGXGGXGXMIXAYLLHRGKF

SEQ ID NO: 27926 - protein, 23 aa, Artificial Sequence
  Description of Artificial Sequence: Synthetic peptide
  Seed: CKAGKGGTGVMICAYLLHRGKFL (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXAYLLHRGKFL

SEQ ID NO: 27927 - protein, 24 aa, Artificial Sequence
  Description of Artificial Sequence: Synthetic peptide
  Seed: CKAGKGGTGVMICAYLLHRGKFLK (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXAYLLHRGKFLK

SEQ ID NO: 27928 - protein, 25 aa, Artificial Sequence
  Description of Artificial Sequence: Synthetic peptide
  Seed: CKAGKGGTGVMICAYLLHRGKFLKA (PTEN R130G)
  Core: KGGTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGGXGXMIXAYLLHRGKFLKA

SEQ ID NO: 27929 - protein, 14 aa, Artificial Sequence
  Description of Artificial Sequence: Synthetic peptide
  Seed: HCKAGKGGTGVMIC (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIX

SEQ ID NO: 27930 - protein, 15 aa, Artificial Sequence
  Description of Artificial Sequence: Synthetic peptide
  Seed: HCKAGKGGTGVMICA (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXA

SEQ ID NO: 27931 - protein, 16 aa, Artificial Sequence
  Description of Artificial Sequence: Synthetic peptide
  Seed: HCKAGKGGTGVMICAY (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAY

SEQ ID NO: 27932 - protein, 17 aa, Artificial Sequence
  Description of Artificial Sequence: Synthetic peptide
  Seed: HCKAGKGGTGVMICAYL (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAYL

SEQ ID NO: 27933 - protein, 18 aa, Artificial Sequence
  Description of Artificial Sequence: Synthetic peptide
  Seed: HCKAGKGGTGVMICAYLL (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAYLL

SEQ ID NO: 27934 - protein, 19 aa, Artificial Sequence
  Description of Artificial Sequence: Synthetic peptide
  Seed: HCKAGKGGTGVMICAYLLH (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAYLLH

SEQ ID NO: 27935 - protein, 20 aa, Artificial Sequence
  Description of Artificial Sequence: Synthetic peptide
  Seed: HCKAGKGGTGVMICAYLLHR (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAYLLHR

SEQ ID NO: 27936 - protein, 21 aa, Artificial Sequence
  Description of Artificial Sequence: Synthetic peptide
  Seed: HCKAGKGGTGVMICAYLLHRG (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAYLLHRG

SEQ ID NO: 27937 - protein, 22 aa, Artificial Sequence
  Description of Artificial Sequence: Synthetic peptide
  Seed: HCKAGKGGTGVMICAYLLHRGK (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAYLLHRGK

SEQ ID NO: 27938 - protein, 23 aa, Artificial Sequence
  Description of Artificial Sequence: Synthetic peptide
  Seed: HCKAGKGGTGVMICAYLLHRGKF (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAYLLHRGKF

SEQ ID NO: 27939 - protein, 24 aa, Artificial Sequence
  Description of Artificial Sequence: Synthetic peptide
  Seed: HCKAGKGGTGVMICAYLLHRGKFL (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAYLLHRGKFL

SEQ ID NO: 27940 - protein, 25 aa, Artificial Sequence
  Description of Artificial Sequence: Synthetic peptide
  Seed: HCKAGKGGTGVMICAYLLHRGKFLK (PTEN R130G)
  Core: KGGTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGGXGXMIXAYLLHRGKFLK

SEQ ID NO: 27941 - protein, 20 aa, Artificial Sequence
  Description of Artificial Sequence: Synthetic peptide
  Seed: HVAAIHCKAGKGGTGVMICA (PTEN R130G)
  Core: CKAGKGGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXGTXVMICA

SEQ ID NO: 27942 - protein, 22 aa, Artificial Sequence
  Description of Artificial Sequence: Synthetic peptide
  Seed: HVAAIHCKAGKGGTGVMICAYL (PTEN R130G)
  Core: KGGTGVMIC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHCKAGXGGXGXMIXAYL

SEQ ID NO: 27943 - protein, 23 aa, Artificial Sequence
  Description of Artificial Sequence: Synthetic peptide
  Seed: HVAAIHCKAGKGGTGVMICAYLL (PTEN R130G)
  Core: KGGTGVMIC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHCKAGXGGXGXMIXAYLL

SEQ ID NO: 27944 - protein, 24 aa, Artificial Sequence
  Description of Artificial Sequence: Synthetic peptide
  Seed: HVAAIHCKAGKGGTGVMICAYLLH (PTEN R130G)
  Core: KGGTGVMIC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHCKAGXGGXGXMIXAYLLH

SEQ ID NO: 27945 - protein, 25 aa, Artificial Sequence
  Description of Artificial Sequence: Synthetic peptide
  Seed: HVAAIHCKAGKGGTGVMICAYLLHR (PTEN R130G)
  Core: KGGTGVMIC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHCKAGXGGXGXMIXAYLLHR

SEQ ID NO: 27946 - protein, 14 aa, Artificial Sequence
  Description of Artificial Sequence: Synthetic peptide
  Seed: IHCKAGKGGTGVMI (PTEN R130G)
  Core: CKAGKGGTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXGTXVMI

SEQ ID NO: 27947 - protein, 15 aa, Artificial Sequence
  Description of Artificial Sequence: Synthetic peptide
  Seed: IHCKAGKGGTGVMIC (PTEN R130G)
  Core: CKAGKGGTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXGTXVMIC

SEQ ID NO: 27948 - protein, 16 aa, Artificial Sequence
  Description of Artificial Sequence: Synthetic peptide
  Seed: IHCKAGKGGTGVMICA (PTEN R130G)
  Core: CKAGKGGTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXGTXVMICA

SEQ ID NO: 27949 - protein, 16 aa, Artificial Sequence
  Description of Artificial Sequence: Synthetic peptide
  Seed: IHCKAGKGGTGVMICA (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXA

SEQ ID NO: 27950 - protein, 17 aa, Artificial Sequence
  Description of Artificial Sequence: Synthetic peptide
  Seed: IHCKAGKGGTGVMICAY (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXAY

SEQ ID NO: 27951 - protein, 18 aa, Artificial Sequence
  Description of Artificial Sequence: Synthetic peptide
  Seed: IHCKAGKGGTGVMICAYL (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXAYL

SEQ ID NO: 27952 - protein, 19 aa, Artificial Sequence
  Description of Artificial Sequence: Synthetic peptide
  Seed: IHCKAGKGGTGVMICAYLL (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXAYLL

SEQ ID NO: 27953 - protein, 20 aa, Artificial Sequence
  Description of Artificial Sequence: Synthetic peptide
  Seed: IHCKAGKGGTGVMICAYLLH (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXAYLLH

SEQ ID NO: 27954 - protein, 21 aa, Artificial Sequence
  Description of Artificial Sequence: Synthetic peptide
  Seed: IHCKAGKGGTGVMICAYLLHR (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXAYLLHR

SEQ ID NO: 27955 - protein, 22 aa, Artificial Sequence
  Description of Artificial Sequence: Synthetic peptide
  Seed: IHCKAGKGGTGVMICAYLLHRG (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXAYLLHRG

SEQ ID NO: 27956 - protein, 23 aa, Artificial Sequence
  Description of Artificial Sequence: Synthetic peptide
  Seed: IHCKAGKGGTGVMICAYLLHRGK (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXAYLLHRGK

SEQ ID NO: 27957 - protein, 24 aa, Artificial Sequence
  Description of Artificial Sequence: Synthetic peptide
  Seed: IHCKAGKGGTGVMICAYLLHRGKF (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXAYLLHRGKF

SEQ ID NO: 27958 - protein, 25 aa, Artificial Sequence
  Description of Artificial Sequence: Synthetic peptide
  Seed: IHCKAGKGGTGVMICAYLLHRGKFL (PTEN R130G)
  Core: KGGTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGGXGXMIXAYLLHRGKFL

SEQ ID NO: 27959 - protein, 14 aa, Artificial Sequence
  Description of Artificial Sequence: Synthetic peptide
  Seed: KAGKGGTGVMICAY (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAY

SEQ ID NO: 27960 - protein, 15 aa, Artificial Sequence
  Description of Artificial Sequence: Synthetic peptide
  Seed: KAGKGGTGVMICAYL (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAYL

SEQ ID NO: 27961 - protein, 16 aa, Artificial Sequence
  Description of Artificial Sequence: Synthetic peptide
  Seed: KAGKGGTGVMICAYLL (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAYLL

SEQ ID NO: 27962 - protein, 17 aa, Artificial Sequence
  Description of Artificial Sequence: Synthetic peptide
  Seed: KAGKGGTGVMICAYLLH (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAYLLH

SEQ ID NO: 27963 - protein, 18 aa, Artificial Sequence
  Description of Artificial Sequence: Synthetic peptide
  Seed: KAGKGGTGVMICAYLLHR (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAYLLHR

SEQ ID NO: 27964 - protein, 19 aa, Artificial Sequence
  Description of Artificial Sequence: Synthetic peptide
  Seed: KAGKGGTGVMICAYLLHRG (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAYLLHRG

SEQ ID NO: 27965 - protein, 20 aa, Artificial Sequence
  Description of Artificial Sequence: Synthetic peptide
  Seed: KAGKGGTGVMICAYLLHRGK (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAYLLHRGK

SEQ ID NO: 27966 - protein, 21 aa, Artificial Sequence
  Description of Artificial Sequence: Synthetic peptide
  Seed: KAGKGGTGVMICAYLLHRGKF (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
KAGXGGXGXMIXAYLLHRGKF

SEQ ID NO: 27967 - protein, 22 aa, Artificial Sequence
  Description of Artificial Sequence: Synthetic peptide
  Seed: KAGKGGTGVMICAYLLHRGKFL (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
KAGXGGXGXMIXAYLLHRGKFL

SEQ ID NO: 27968 - protein, 23 aa, Artificial Sequence
  Description of Artificial Sequence: Synthetic peptide
  Seed: KAGKGGTGVMICAYLLHRGKFLK (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAYLLHRGKFLK

SEQ ID NO: 27969 - protein, 24 aa, Artificial Sequence
  Description of Artificial Sequence: Synthetic peptide
  Seed: KAGKGGTGVMICAYLLHRGKFLKA (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAYLLHRGKFLKA

SEQ ID NO: 27970 - protein, 25 aa, Artificial Sequence
  Description of Artificial Sequence: Synthetic peptide
  Seed: KAGKGGTGVMICAYLLHRGKFLKAQ (PTEN R130G)
  Core: KGGTGVMIC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KAGXGGXGXMIXAYLLHRGKFLKAQ

SEQ ID NO: 27971 - protein, 25 aa, Artificial Sequence
  Description of Artificial Sequence: Synthetic peptide
  Seed: NHVAAIHCKAGKGGTGVMICAYLLH (PTEN R130G)
  Core: KGGTGVMIC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NHVAAIHCKAGXGGXGXMIXAYLLH

SEQ ID NO: 27972 - protein, 19 aa, Artificial Sequence
  Description of Artificial Sequence: Synthetic peptide
  Seed: VAAIHCKAGKGGTGVMICA (PTEN R130G)
  Core: CKAGKGGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXGTXVMICA

SEQ ID NO: 27973 - protein, 20 aa, Artificial Sequence
  Description of Artificial Sequence: Synthetic peptide
  Seed: VAAIHCKAGKGGTGVMICAY (PTEN R130G)
  Core: CKAGKGGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXGTXVMICAY

SEQ ID NO: 27974 - protein, 20 aa, Artificial Sequence
  Description of Artificial Sequence: Synthetic peptide
  Seed: VAAIHCKAGKGGTGVMICAY (PTEN R130G)
  Core: KGGTGVMIC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHCKAGXGGXGXMIXAY

SEQ ID NO: 27975 - protein, 21 aa, Artificial Sequence
  Description of Artificial Sequence: Synthetic peptide
  Seed: VAAIHCKAGKGGTGVMICAYL (PTEN R130G)
  Core: KGGTGVMIC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHCKAGXGGXGXMIXAYL

SEQ ID NO: 27976 - protein, 22 aa, Artificial Sequence
  Description of Artificial Sequence: Synthetic peptide
  Seed: VAAIHCKAGKGGTGVMICAYLL (PTEN R130G)
  Core: KGGTGVMIC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHCKAGXGGXGXMIXAYLL

SEQ ID NO: 27977 - protein, 23 aa, Artificial Sequence
  Description of Artificial Sequence: Synthetic peptide
  Seed: VAAIHCKAGKGGTGVMICAYLLH (PTEN R130G)
  Core: KGGTGVMIC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHCKAGXGGXGXMIXAYLLH

SEQ ID NO: 27978 - protein, 24 aa, Artificial Sequence
  Description of Artificial Sequence: Synthetic peptide
  Seed: VAAIHCKAGKGGTGVMICAYLLHR (PTEN R130G)
  Core: KGGTGVMIC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHCKAGXGGXGXMIXAYLLHR

SEQ ID NO: 27979 - protein, 25 aa, Artificial Sequence
  Description of Artificial Sequence: Synthetic peptide
  Seed: VAAIHCKAGKGGTGVMICAYLLHRG (PTEN R130G)
  Core: KGGTGVMIC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHCKAGXGGXGXMIXAYLLHRG

SEQ ID NO: 27980 - protein, 15 aa, Artificial Sequence
  Description of Artificial Sequence: Synthetic peptide
  Seed: AAIHCKAGKGQTGVM (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVM

SEQ ID NO: 27981 - protein, 16 aa, Artificial Sequence
  Description of Artificial Sequence: Synthetic peptide
  Seed: AAIHCKAGKGQTGVMI (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVMI

SEQ ID NO: 27982 - protein, 17 aa, Artificial Sequence
  Description of Artificial Sequence: Synthetic peptide
  Seed: AAIHCKAGKGQTGVMIC (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVMIC

SEQ ID NO: 27983 - protein, 19 aa, Artificial Sequence
  Description of Artificial Sequence: Synthetic peptide
  Seed: AAIHCKAGKGQTGVMICAY (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVMICAY

SEQ ID NO: 27984 - protein, 20 aa, Artificial Sequence
  Description of Artificial Sequence: Synthetic peptide
  Seed: AAIHCKAGKGQTGVMICAYL (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVMICAYL

SEQ ID NO: 27985 - protein, 21 aa, Artificial Sequence
  Description of Artificial Sequence: Synthetic peptide
  Seed: AAIHCKAGKGQTGVMICAYLL (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVMICAYLL

SEQ ID NO: 27986 - protein, 22 aa, Artificial Sequence
  Description of Artificial Sequence: Synthetic peptide
  Seed: AAIHCKAGKGQTGVMICAYLLH (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVMICAYLLH

SEQ ID NO: 27987 - protein, 23 aa, Artificial Sequence
  Description of Artificial Sequence: Synthetic peptide
  Seed: AAIHCKAGKGQTGVMICAYLLHR (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVMICAYLLHR

SEQ ID NO: 27988 - protein, 23 aa, Artificial Sequence
  Description of Artificial Sequence: Synthetic peptide
  Seed: AAIHCKAGKGQTGVMICAYLLHR (PTEN R130Q)
  Core: KGQTGVMIC
  misc_feature (9)..(9): Xaa can be Phe, His, Ile, Lys, Leu, Met, Gln, Arg, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AAIHCKAGXGQXGXMIXAYLLHR

SEQ ID NO: 27989 - protein, 24 aa, Artificial Sequence
  Description of Artificial Sequence: Synthetic peptide
  Seed: AAIHCKAGKGQTGVMICAYLLHRG (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVMICAYLLHRG

SEQ ID NO: 27990 - protein, 25 aa, Artificial Sequence
  Description of Artificial Sequence: Synthetic peptide
  Seed: AAIHCKAGKGQTGVMICAYLLHRGK (PTEN R130Q)
  Core: CKAGKGQTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AAIHXKAXKXQTXVMICAYLLHRGK

SEQ ID NO: 27991 - protein, 15 aa, Artificial Sequence
  Description of Artificial Sequence: Synthetic peptide
  Seed: AGKGQTGVMICAYLL (PTEN R130Q)
  Core: GQTGVMICA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Gly, His, Met, Asn, Pro, Ser, Thr, Val, or Trp
  misc_feature (9)..(9): Xaa can be Ala, Cys, Asp, Glu, Gly, Ile, Leu, Met, Asn, Pro, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AGKXQTXVXICXYLL

SEQ ID NO: 27992 - protein, 14 aa, Artificial Sequence
  Description of Artificial Sequence: Synthetic peptide
  Seed: AIHCKAGKGQTGVM (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVM

SEQ ID NO: 27993 - protein, 15 aa, Artificial Sequence
  Description of Artificial Sequence: Synthetic peptide
  Seed: AIHCKAGKGQTGVMI (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMI

SEQ ID NO: 27994 - protein, 16 aa, Artificial Sequence
  Description of Artificial Sequence: Synthetic peptide
  Seed: AIHCKAGKGQTGVMIC (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMIC

SEQ ID NO: 27995 - protein, 17 aa, Artificial Sequence
  Description of Artificial Sequence: Synthetic peptide
  Seed: AIHCKAGKGQTGVMICA (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMICA

SEQ ID NO: 27996 - protein, 18 aa, Artificial Sequence
  Description of Artificial Sequence: Synthetic peptide
  Seed: AIHCKAGKGQTGVMICAY (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMICAY

SEQ ID NO: 27997 - protein, 19 aa, Artificial Sequence
  Description of Artificial Sequence: Synthetic peptide
  Seed: AIHCKAGKGQTGVMICAYL (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMICAYL

SEQ ID NO: 27998 - protein, 20 aa, Artificial Sequence
  Description of Artificial Sequence: Synthetic peptide
  Seed: AIHCKAGKGQTGVMICAYLL (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMICAYLL

SEQ ID NO: 27999 - protein, 21 aa, Artificial Sequence
  Description of Artificial Sequence: Synthetic peptide
  Seed: AIHCKAGKGQTGVMICAYLLH (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMICAYLLH

SEQ ID NO: 28000 - protein, 22 aa, Artificial Sequence
  Description of Artificial Sequence: Synthetic peptide
  Seed: AIHCKAGKGQTGVMICAYLLHR (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMICAYLLHR

SEQ ID NO: 28001 - protein, 22 aa, Artificial Sequence
  Description of Artificial Sequence: Synthetic peptide
  Seed: AIHCKAGKGQTGVMICAYLLHR (PTEN R130Q)
  Core: KGQTGVMIC
  misc_feature (8)..(8): Xaa can be Phe, His, Ile, Lys, Leu, Met, Gln, Arg, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIHCKAGXGQXGXMIXAYLLHR

SEQ ID NO: 28002 - protein, 23 aa, Artificial Sequence
  Description of Artificial Sequence: Synthetic peptide
  Seed: AIHCKAGKGQTGVMICAYLLHRG (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMICAYLLHRG

SEQ ID NO: 28003 - protein, 24 aa, Artificial Sequence
  Description of Artificial Sequence: Synthetic peptide
  Seed: AIHCKAGKGQTGVMICAYLLHRGK (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMICAYLLHRGK

SEQ ID NO: 28004 - protein, 25 aa, Artificial Sequence
  Description of Artificial Sequence: Synthetic peptide
  Seed: AIHCKAGKGQTGVMICAYLLHRGKF (PTEN R130Q)
  Core: CKAGKGQTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AIHXKAXKXQTXVMICAYLLHRGKF

SEQ ID NO: 28005 - protein, 14 aa, Artificial Sequence
  Description of Artificial Sequence: Synthetic peptide
  Seed: CKAGKGQTGVMICA (PTEN R130Q)
  Core: GQTGVMICA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Leu, Met, Asn, Pro, Gln, Ser, Thr, Val, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKAGKXQTXVXICX

SEQ ID NO: 28006 - protein, 15 aa, Artificial Sequence
  Description of Artificial Sequence: Synthetic peptide
  Seed: CKAGKGQTGVMICAY (PTEN R130Q)
  Core: KGQTGVMIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CKAGXGQXGXMIXAY

SEQ ID NO: 28007 - protein, 15 aa, Artificial Sequence
  Description of Artificial Sequence: Synthetic peptide
  Seed: CKAGKGQTGVMICAY (PTEN R130Q)
  Core: GQTGVMICA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKAGKXQTXVXICXY

SEQ ID NO: 28008 - protein, 16 aa, Artificial Sequence
  Description of Artificial Sequence: Synthetic peptide
  Seed: CKAGKGQTGVMICAYL (PTEN R130Q)
  Core: GQTGVMICA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CKAGKXQTXVXICXYL

SEQ ID NO: 28009 - protein, 15 aa, Artificial Sequence
  Description of Artificial Sequence: Synthetic peptide
  Seed: HCKAGKGQTGVMICA (PTEN R130Q)
  Core: CKAGKGQTG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXKAXKXQTXVMICA

SEQ ID NO: 28010 - protein, 16 aa, Artificial Sequence
  Description of Artificial Sequence: Synthetic peptide
  Seed: HCKAGKGQTGVMICAY (PTEN R130Q)
  Core: CKAGKGQTG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXKAXKXQTXVMICAY

SEQ ID NO: 28011 - protein, 16 aa, Artificial Sequence
  Description of Artificial Sequence: Synthetic peptide
  Seed: HCKAGKGQTGVMICAY (PTEN R130Q)
  Core: KGQTGVMIC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HCKAGXGQXGXMIXAY

SEQ ID NO: 28012 - protein, 17 aa, Artificial Sequence
  Description of Artificial Sequence: Synthetic peptide
  Seed: HCKAGKGQTGVMICAYL (PTEN R130Q)
  Core: CKAGKGQTG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXKAXKXQTXVMICAYL

SEQ ID NO: 28013 - protein, 16 aa, Artificial Sequence
  Description of Artificial Sequence: Synthetic peptide
  Seed: HVAAIHCKAGKGQTGV (PTEN R130Q)
  Core: CKAGKGQTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXQTXV

SEQ ID NO: 28014 - protein, 17 aa, Artificial Sequence
  Description of Artificial Sequence: Synthetic peptide
  Seed: HVAAIHCKAGKGQTGVM (PTEN R130Q)
  Core: CKAGKGQTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXQTXVM

SEQ ID NO: 28015 - protein, 19 aa, Artificial Sequence
  Description of Artificial Sequence: Synthetic peptide
  Seed: HVAAIHCKAGKGQTGVMIC (PTEN R130Q)
  Core: CKAGKGQTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXQTXVMIC

SEQ ID NO: 28016 - protein, 20 aa, Artificial Sequence
  Description of Artificial Sequence: Synthetic peptide
  Seed: HVAAIHCKAGKGQTGVMICA (PTEN R130Q)
  Core: CKAGKGQTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXQTXVMICA

SEQ ID NO: 28017 - protein, 21 aa, Artificial Sequence
  Description of Artificial Sequence: Synthetic peptide
  Seed: HVAAIHCKAGKGQTGVMICAY (PTEN R130Q)
  Core: CKAGKGQTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXQTXVMICAY

SEQ ID NO: 28018 - protein, 22 aa, Artificial Sequence
  Description of Artificial Sequence: Synthetic peptide
  Seed: HVAAIHCKAGKGQTGVMICAYL (PTEN R130Q)
  Core: CKAGKGQTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXQTXVMICAYL

SEQ ID NO: 28019 - protein, 23 aa, Artificial Sequence
  Description of Artificial Sequence: Synthetic peptide
  Seed: HVAAIHCKAGKGQTGVMICAYLL (PTEN R130Q)
  Core: CKAGKGQTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXQTXVMICAYLL

SEQ ID NO: 28020 - protein, 24 aa, Artificial Sequence
  Description of Artificial Sequence: Synthetic peptide
  Seed: HVAAIHCKAGKGQTGVMICAYLLH (PTEN R130Q)
  Core: CKAGKGQTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXQTXVMICAYLLH

SEQ ID NO: 28021 - protein, 25 aa, Artificial Sequence
  Description of Artificial Sequence: Synthetic peptide
  Seed: HVAAIHCKAGKGQTGVMICAYLLHR (PTEN R130Q)
  Core: CKAGKGQTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHXKAXKXQTXVMICAYLLHR

SEQ ID NO: 28022 - protein, 25 aa, Artificial Sequence
  Description of Artificial Sequence: Synthetic peptide
  Seed: HVAAIHCKAGKGQTGVMICAYLLHR (PTEN R130Q)
  Core: KGQTGVMIC
  misc_feature (11)..(11): Xaa can be Cys, Phe, Ile, Lys, Leu, Met, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HVAAIHCKAGXGQXGXMIXAYLLHR

SEQ ID NO: 28023 - protein, 14 aa, Artificial Sequence
  Description of Artificial Sequence: Synthetic peptide
  Seed: IHCKAGKGQTGVMI (PTEN R130Q)
  Core: CKAGKGQTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXQTXVMI

SEQ ID NO: 28024 - protein, 15 aa, Artificial Sequence
  Description of Artificial Sequence: Synthetic peptide
  Seed: IHCKAGKGQTGVMIC (PTEN R130Q)
  Core: CKAGKGQTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXQTXVMIC

SEQ ID NO: 28025 - protein, 16 aa, Artificial Sequence
  Description of Artificial Sequence: Synthetic peptide
  Seed: IHCKAGKGQTGVMICA (PTEN R130Q)
  Core: CKAGKGQTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXQTXVMICA

SEQ ID NO: 28026 - protein, 17 aa, Artificial Sequence
  Description of Artificial Sequence: Synthetic peptide
  Seed: IHCKAGKGQTGVMICAY (PTEN R130Q)
  Core: CKAGKGQTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXQTXVMICAY

SEQ ID NO: 28027 - protein, 18 aa, Artificial Sequence
  Description of Artificial Sequence: Synthetic peptide
  Seed: IHCKAGKGQTGVMICAYL (PTEN R130Q)
  Core: CKAGKGQTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXQTXVMICAYL

SEQ ID NO: 28028 - protein, 19 aa, Artificial Sequence
  Description of Artificial Sequence: Synthetic peptide
  Seed: IHCKAGKGQTGVMICAYLL (PTEN R130Q)
  Core: CKAGKGQTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXQTXVMICAYLL

SEQ ID NO: 28029 - protein, 20 aa, Artificial Sequence
  Description of Artificial Sequence: Synthetic peptide
  Seed: IHCKAGKGQTGVMICAYLLH (PTEN R130Q)
  Core: KGQTGVMIC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGQXGXMIXAYLLH

SEQ ID NO: 28030 - protein, 21 aa, Artificial Sequence
  Description of Artificial Sequence: Synthetic peptide
  Seed: IHCKAGKGQTGVMICAYLLHR (PTEN R130Q)
  Core: CKAGKGQTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXQTXVMICAYLLHR

SEQ ID NO: 28031 - protein, 21 aa, Artificial Sequence
  Description of Artificial Sequence: Synthetic peptide
  Seed: IHCKAGKGQTGVMICAYLLHR (PTEN R130Q)
  Core: KGQTGVMIC
  misc_feature (7)..(7): Xaa can be Phe, Ile, Lys, Leu, Met, Gln, Arg, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IHCKAGXGQXGXMIXAYLLHR

SEQ ID NO: 28032 - protein, 22 aa, Artificial Sequence
  Description of Artificial Sequence: Synthetic peptide
  Seed: IHCKAGKGQTGVMICAYLLHRG (PTEN R130Q)
  Core: CKAGKGQTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IHXKAXKXQTXVMICAYLLHRG

SEQ ID NO: 28033 - protein, 14 aa, Artificial Sequence
  Description of Artificial Sequence: Synthetic peptide
  Seed: KAGKGQTGVMICAY (PTEN R130Q)
  Core: GQTGVMICA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Gly, His, Ile, Met, Asn, Pro, Ser, Thr, Val, or Trp
  misc_feature (10)..(10): Xaa can be Ala, Cys, Asp, Glu, Phe, Gly, Ile, Leu, Met, Asn, Pro, Gln, Ser, Thr, Val, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KAGKXQTXVXICXY

SEQ ID NO: 28034 - protein, 15 aa, Artificial Sequence
  Description of Artificial Sequence: Synthetic peptide
  Seed: KAGKGQTGVMICAYL (PTEN R130Q)
  Core: GQTGVMICA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Gly, His, Met, Ser, Thr, or Trp
  misc_feature (10)..(10): Xaa can be Ala, Cys, Glu, Gly, Ile, Leu, Met, Asn, Pro, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KAGKXQTXVXICXYL

SEQ ID NO: 28035 - protein, 16 aa, Artificial Sequence
  Description of Artificial Sequence: Synthetic peptide
  Seed: KAGKGQTGVMICAYLL (PTEN R130Q)
  Core: GQTGVMICA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Gly, His, Met, Asn, Pro, Ser, Thr, or Trp
  misc_feature (10)..(10): Xaa can be Ala, Cys, Gly, Ile, Leu, Met, Asn, Pro, Ser, Thr, or Val
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KAGKXQTXVXICXYLL

SEQ ID NO: 28036 - protein, 19 aa, Artificial Sequence
  Description of Artificial Sequence: Synthetic peptide
  Seed: NHVAAIHCKAGKGQTGVMI (PTEN R130Q)
  Core: CKAGKGQTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NHVAAIHXKAXKXQTXVMI

SEQ ID NO: 28037 - protein, 20 aa, Artificial Sequence
  Description of Artificial Sequence: Synthetic peptide
  Seed: NHVAAIHCKAGKGQTGVMIC (PTEN R130Q)
  Core: CKAGKGQTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NHVAAIHXKAXKXQTXVMIC

SEQ ID NO: 28038 - protein, 22 aa, Artificial Sequence
  Description of Artificial Sequence: Synthetic peptide
  Seed: NHVAAIHCKAGKGQTGVMICAY (PTEN R130Q)
  Core: CKAGKGQTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NHVAAIHXKAXKXQTXVMICAY

SEQ ID NO: 28039 - protein, 23 aa, Artificial Sequence
  Description of Artificial Sequence: Synthetic peptide
  Seed: NHVAAIHCKAGKGQTGVMICAYL (PTEN R130Q)
  Core: CKAGKGQTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NHVAAIHXKAXKXQTXVMICAYL

SEQ ID NO: 28040 - protein, 24 aa, Artificial Sequence
  Description of Artificial Sequence: Synthetic peptide
  Seed: NHVAAIHCKAGKGQTGVMICAYLL (PTEN R130Q)
  Core: CKAGKGQTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NHVAAIHXKAXKXQTXVMICAYLL

SEQ ID NO: 28041 - protein, 25 aa, Artificial Sequence
  Description of Artificial Sequence: Synthetic peptide
  Seed: NHVAAIHCKAGKGQTGVMICAYLLH (PTEN R130Q)
  Core: CKAGKGQTG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NHVAAIHXKAXKXQTXVMICAYLLH

SEQ ID NO: 28042 - protein, 15 aa, Artificial Sequence
  Description of Artificial Sequence: Synthetic peptide
  Seed: VAAIHCKAGKGQTGV (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXV

SEQ ID NO: 28043 - protein, 16 aa, Artificial Sequence
  Description of Artificial Sequence: Synthetic peptide
  Seed: VAAIHCKAGKGQTGVM (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXVM

SEQ ID NO: 28044 - protein, 17 aa, Artificial Sequence
  Description of Artificial Sequence: Synthetic peptide
  Seed: VAAIHCKAGKGQTGVMI (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXVMI

SEQ ID NO: 28045 - protein, 19 aa, Artificial Sequence
  Description of Artificial Sequence: Synthetic peptide
  Seed: VAAIHCKAGKGQTGVMICA (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXVMICA

SEQ ID NO: 28046 - protein, 20 aa, Artificial Sequence
  Description of Artificial Sequence: Synthetic peptide
  Seed: VAAIHCKAGKGQTGVMICAY (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXVMICAY

SEQ ID NO: 28047 - protein, 21 aa, Artificial Sequence
  Description of Artificial Sequence: Synthetic peptide
  Seed: VAAIHCKAGKGQTGVMICAYL (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXVMICAYL

SEQ ID NO: 28048 - protein, 22 aa, Artificial Sequence
  Description of Artificial Sequence: Synthetic peptide
  Seed: VAAIHCKAGKGQTGVMICAYLL (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXVMICAYLL

SEQ ID NO: 28049 - protein, 23 aa, Artificial Sequence
  Description of Artificial Sequence: Synthetic peptide
  Seed: VAAIHCKAGKGQTGVMICAYLLH (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXVMICAYLLH

SEQ ID NO: 28050 - protein, 24 aa, Artificial Sequence
  Description of Artificial Sequence: Synthetic peptide
  Seed: VAAIHCKAGKGQTGVMICAYLLHR (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXVMICAYLLHR

SEQ ID NO: 28051 - protein, 24 aa, Artificial Sequence
  Description of Artificial Sequence: Synthetic peptide
  Seed: VAAIHCKAGKGQTGVMICAYLLHR (PTEN R130Q)
  Core: KGQTGVMIC
  misc_feature (10)..(10): Xaa can be Phe, His, Ile, Lys, Leu, Met, Gln, Arg, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHCKAGXGQXGXMIXAYLLHR

SEQ ID NO: 28052 - protein, 25 aa, Artificial Sequence
  Description of Artificial Sequence: Synthetic peptide
  Seed: VAAIHCKAGKGQTGVMICAYLLHRG (PTEN R130Q)
  Core: CKAGKGQTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VAAIHXKAXKXQTXVMICAYLLHRG

SEQ ID NO: 28053 - protein, 21 aa, Artificial Sequence
  Description of Artificial Sequence: Synthetic peptide
  Seed: AIYKQSQHMTEVVRRCPHRER (TP53 H179R)
  Core: VVRRCPHRE
  misc_feature (12)..(12): Xaa can be Ala, Cys, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEXVRXCXHRXR

SEQ ID NO: 28054 - protein, 22 aa, Artificial Sequence
  Description of Artificial Sequence: Synthetic peptide
  Seed: AIYKQSQHMTEVVRRCPHRERC (TP53 H179R)
  Core: VVRRCPHRE
  misc_feature (12)..(12): Xaa can be Ala, Cys, Phe, His, Ile, Leu, Met, Asn, Pro, Gln, Thr, Val, Trp, or Tyr
  misc_feature (15)..(15): Xaa can be Ala, Cys, Glu, Phe, Gly, His, Ile, Lys, Leu, Met, Asn, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEXVRXCXHRXRC

SEQ ID NO: 28055 - protein, 23 aa, Artificial Sequence
  Description of Artificial Sequence: Synthetic peptide
  Seed: AIYKQSQHMTEVVRRCPHRERCS (TP53 H179R)
  Core: VVRRCPHRE
  misc_feature (12)..(12): Xaa can be Ala, Cys, Phe, His, Ile, Lys, Leu, Met, Gln, Arg, Thr, Val, Trp, or Tyr
  misc_feature (15)..(15): Xaa can be Ala, Cys, Glu, Phe, Gly, His, Ile, Lys, Leu, Met, Asn, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEXVRXCXHRXRCS

SEQ ID NO: 28056 - protein, 23 aa, Artificial Sequence
  Description of Artificial Sequence: Synthetic peptide
  Seed: AIYKQSQHMTEVVRRCPHRERCS (TP53 H179R)
  Core: VRRCPHRER
  misc_feature (13)..(13): Xaa can be Ala, Cys, Phe, Ile, Leu, Met, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEVXRRXPXREXCS

SEQ ID NO: 28057 - protein, 24 aa, Artificial Sequence
  Description of Artificial Sequence: Synthetic peptide
  Seed: AIYKQSQHMTEVVRRCPHRERCSD (TP53 H179R)
  Core: VVRRCPHRE
  misc_feature (12)..(12): Xaa can be Phe, Ile, Leu, Met, Arg, Val, Trp, or Tyr
  misc_feature (15)..(15): Xaa can be Ala, Cys, Glu, Phe, Gly, His, Ile, Lys, Leu, Met, Asn, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEXVRXCXHRXRCSD

SEQ ID NO: 28058 - protein, 24 aa, Artificial Sequence
  Description of Artificial Sequence: Synthetic peptide
  Seed: AIYKQSQHMTEVVRRCPHRERCSD (TP53 H179R)
  Core: VRRCPHRER
  misc_feature (13)..(13): Xaa can be Ala, Cys, Phe, Gly, Ile, Leu, Met, Pro, Gln, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEVXRRXPXREXCSD

SEQ ID NO: 28059 - protein, 25 aa, Artificial Sequence
  Description of Artificial Sequence: Synthetic peptide
  Seed: AIYKQSQHMTEVVRRCPHRERCSDS (TP53 H179R)
  Core: VVRRCPHRE
  misc_feature (12)..(12): Xaa can be Phe, His, Ile, Leu, Met, Arg, Val, Trp, or Tyr
  misc_feature (15)..(15): Xaa can be Ala, Cys, Glu, Phe, Gly, His, Ile, Lys, Leu, Met, Asn, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEXVRXCXHRXRCSDS

SEQ ID NO: 28060 - protein, 25 aa, Artificial Sequence
  Description of Artificial Sequence: Synthetic peptide
  Seed: AIYKQSQHMTEVVRRCPHRERCSDS (TP53 H179R)
  Core: VRRCPHRER
  misc_feature (13)..(13): Xaa can be Ala, Cys, Phe, Gly, His, Ile, Leu, Met, Pro, Gln, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEVXRRXPXREXCSDS

SEQ ID NO: 28061 - protein, 23 aa, Artificial Sequence
  Description of Artificial Sequence: Synthetic peptide
  Seed: AMAIYKQSQHMTEVVRRCPHRER (TP53 H179R)
  Core: VVRRCPHRE
  misc_feature (14)..(14): Xaa can be Ala, Cys, Phe, Ile, Leu, Met, Pro, Gln, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHMTEXVRXCXHRXR

SEQ ID NO: 28062 - protein, 24 aa, Artificial Sequence
  Description of Artificial Sequence: Synthetic peptide
  Seed: AMAIYKQSQHMTEVVRRCPHRERC (TP53 H179R)
  Core: VVRRCPHRE
  misc_feature (14)..(14): Xaa can be Cys, Phe, Ile, Leu, Met, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHMTEXVRXCXHRXRC

SEQ ID NO: 28063 - protein, 24 aa, Artificial Sequence
  Description of Artificial Sequence: Synthetic peptide
  Seed: AMAIYKQSQHMTEVVRRCPHRERC (TP53 H179R)
  Core: VRRCPHRER
  misc_feature (15)..(15): Xaa can be Phe, Ile, Leu, Met, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Gly, His, Ile, Lys, Asn, Pro, Gln, Arg, Ser, Thr, Val, or Trp
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHMTEVXRRXPXREXC

SEQ ID NO: 28064 - protein, 25 aa, Artificial Sequence
  Description of Artificial Sequence: Synthetic peptide
  Seed: AMAIYKQSQHMTEVVRRCPHRERCS (TP53 H179R)
  Core: VVRRCPHRE
  misc_feature (14)..(14): Xaa can be Ala, Cys, Phe, His, Ile, Leu, Met, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHMTEXVRXCXHRXRCS

SEQ ID NO: 28065 - protein, 25 aa, Artificial Sequence
  Description of Artificial Sequence: Synthetic peptide
  Seed: AMAIYKQSQHMTEVVRRCPHRERCS (TP53 H179R)
  Core: VRRCPHRER
  misc_feature (15)..(15): Xaa can be Cys, Phe, Ile, Leu, Met, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, or Trp
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHMTEVXRRXPXREXCS

SEQ ID NO: 28066 - protein, 15 aa, Artificial Sequence
  Description of Artificial Sequence: Synthetic peptide
  Seed: HMTEVVRRCPHRERC (TP53 H179R)
  Core: VVRRCPHRE
  misc_feature (5)..(5): Xaa can be Ala, Cys, Phe, His, Ile, Leu, Met, Gln, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HMTEXVRXCXHRXRC

SEQ ID NO: 28067 - protein, 15 aa, Artificial Sequence
  Description of Artificial Sequence: Synthetic peptide
  Seed: HMTEVVRRCPHRERC (TP53 H179R)
  Core: VRRCPHRER
  misc_feature (6)..(6): Xaa can be Ala, Cys, Asp, Glu, Phe, Gly, His, Ile, Leu, Met, Asn, Pro, Gln, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HMTEVXRRXPXREXC

SEQ ID NO: 28068 - protein, 17 aa, Artificial Sequence
  Description of Artificial Sequence: Synthetic peptide
  Seed: HMTEVVRRCPHRERCSD (TP53 H179R)
  Core: VRRCPHRER
  misc_feature (6)..(6): Xaa can be Ala, Cys, Phe, Gly, His, Ile, Lys, Leu, Met, Asn, Pro, Gln, Arg, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HMTEVXRRXPXREXCSD

SEQ ID NO: 28069 - protein, 20 aa, Artificial Sequence
  Description of Artificial Sequence: Synthetic peptide
  Seed: IYKQSQHMTEVVRRCPHRER (TP53 H179R)
  Core: VVRRCPHRE
  misc_feature (11)..(11): Xaa can be Ala, Cys, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEXVRXCXHRXR

SEQ ID NO: 28070 - protein, 21 aa, Artificial Sequence
  Description of Artificial Sequence: Synthetic peptide
  Seed: IYKQSQHMTEVVRRCPHRERC (TP53 H179R)
  Core: VVRRCPHRE
  misc_feature (11)..(11): Xaa can be Ala, Cys, Phe, His, Ile, Leu, Met, Gln, Arg, Thr, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEXVRXCXHRXRC

SEQ ID NO: 28071 - protein, 22 aa, Artificial Sequence
  Description of Artificial Sequence: Synthetic peptide
  Seed: IYKQSQHMTEVVRRCPHRERCS (TP53 H179R)
  Core: VVRRCPHRE
  misc_feature (11)..(11): Xaa can be Ala, Cys, Phe, His, Ile, Leu, Met, Gln, Arg, Thr, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEXVRXCXHRXRCS

SEQ ID NO: 28072 - protein, 22 aa, Artificial Sequence
  Description of Artificial Sequence: Synthetic peptide
  Seed: IYKQSQHMTEVVRRCPHRERCS (TP53 H179R)
  Core: VRRCPHRER
  misc_feature (12)..(12): Xaa can be Ala, Cys, Phe, Ile, Leu, Met, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEVXRRXPXREXCS

SEQ ID NO: 28073 - protein, 23 aa, Artificial Sequence
  Description of Artificial Sequence: Synthetic peptide
  Seed: IYKQSQHMTEVVRRCPHRERCSD (TP53 H179R)
  Core: VVRRCPHRE
  misc_feature (11)..(11): Xaa can be Phe, Ile, Leu, Met, Arg, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEXVRXCXHRXRCSD

SEQ ID NO: 28074 - protein, 23 aa, Artificial Sequence
  Description of Artificial Sequence: Synthetic peptide
  Seed: IYKQSQHMTEVVRRCPHRERCSD (TP53 H179R)
  Core: VRRCPHRER
  misc_feature (12)..(12): Xaa can be Ala, Cys, Phe, Gly, His, Ile, Leu, Met, Pro, Gln, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEVXRRXPXREXCSD

SEQ ID NO: 28075 - protein, 24 aa, Artificial Sequence
  Description of Artificial Sequence: Synthetic peptide
  Seed: IYKQSQHMTEVVRRCPHRERCSDS (TP53 H179R)
  Core: VVRRCPHRE
  misc_feature (11)..(11): Xaa can be Phe, Ile, Leu, Met, Arg, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEXVRXCXHRXRCSDS

SEQ ID NO: 28076 - protein, 24 aa, Artificial Sequence
  Description of Artificial Sequence: Synthetic peptide
  Seed: IYKQSQHMTEVVRRCPHRERCSDS (TP53 H179R)
  Core: VRRCPHRER
  misc_feature (12)..(12): Xaa can be Ala, Cys, Phe, Gly, His, Ile, Leu, Met, Pro, Gln, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEVXRRXPXREXCSDS

SEQ ID NO: 28077 - protein, 25 aa, Artificial Sequence
  Description of Artificial Sequence: Synthetic peptide
  Seed: IYKQSQHMTEVVRRCPHRERCSDSD (TP53 H179R)
  Core: VVRRCPHRE
  misc_feature (11)..(11): Xaa can be Phe, Ile, Leu, Met, Arg, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEXVRXCXHRXRCSDSD

SEQ ID NO: 28078 - protein, 25 aa, Artificial Sequence
  Description of Artificial Sequence: Synthetic peptide
  Seed: IYKQSQHMTEVVRRCPHRERCSDSD (TP53 H179R)
  Core: VRRCPHRER
  misc_feature (12)..(12): Xaa can be Ala, Cys, Phe, Gly, His, Ile, Leu, Met, Pro, Gln, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEVXRRXPXREXCSDSD

SEQ ID NO: 28079 - protein, 20 aa, Artificial Sequence
  Description of Artificial Sequence: Synthetic peptide
  Seed: KQSQHMTEVVRRCPHRERCS (TP53 H179R)
  Core: VVRRCPHRE
  misc_feature (9)..(9): Xaa can be Ala, Cys, Phe, His, Ile, Leu, Met, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KQSQHMTEXVRXCXHRXRCS

SEQ ID NO: 28080 - protein, 20 aa, Artificial Sequence
  Description of Artificial Sequence: Synthetic peptide
  Seed: KQSQHMTEVVRRCPHRERCS (TP53 H179R)
  Core: VRRCPHRER
  misc_feature (10)..(10): Xaa can be Ala, Cys, Phe, Ile, Leu, Met, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQSQHMTEVXRRXPXREXCS

SEQ ID NO: 28081 - protein, 21 aa, Artificial Sequence
  Description of Artificial Sequence: Synthetic peptide
  Seed: KQSQHMTEVVRRCPHRERCSD (TP53 H179R)
  Core: VRRCPHRER
  misc_feature (10)..(10): Xaa can be Ala, Cys, Phe, Gly, His, Ile, Leu, Met, Pro, Gln, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQSQHMTEVXRRXPXREXCSD

SEQ ID NO: 28082 - protein, 22 aa, Artificial Sequence
  Description of Artificial Sequence: Synthetic peptide
  Seed: KQSQHMTEVVRRCPHRERCSDS (TP53 H179R)
  Core: VRRCPHRER
  misc_feature (10)..(10): Xaa can be Ala, Cys, Phe, Gly, His, Ile, Leu, Met, Pro, Gln, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQSQHMTEVXRRXPXREXCSDS

SEQ ID NO: 28083 - protein, 23 aa, Artificial Sequence
  Description of Artificial Sequence: Synthetic peptide
  Seed: KQSQHMTEVVRRCPHRERCSDSD (TP53 H179R)
  Core: VRRCPHRER
  misc_feature (10)..(10): Xaa can be Ala, Cys, Phe, Gly, His, Ile, Leu, Met, Pro, Gln, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQSQHMTEVXRRXPXREXCSDSD

SEQ ID NO: 28084 - protein, 24 aa, Artificial Sequence
  Description of Artificial Sequence: Synthetic peptide
  Seed: KQSQHMTEVVRRCPHRERCSDSDG (TP53 H179R)
  Core: VRRCPHRER
  misc_feature (10)..(10): Xaa can be Ala, Cys, Phe, Gly, His, Ile, Leu, Met, Pro, Gln, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQSQHMTEVXRRXPXREXCSDSDG

SEQ ID NO: 28085 - protein, 25 aa, Artificial Sequence
  Description of Artificial Sequence: Synthetic peptide
  Seed: KQSQHMTEVVRRCPHRERCSDSDGL (TP53 H179R)
  Core: VRRCPHRER
  misc_feature (10)..(10): Xaa can be Ala, Cys, Phe, Gly, His, Ile, Leu, Met, Pro, Gln, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQSQHMTEVXRRXPXREXCSDSDGL

SEQ ID NO: 28086 - protein, 22 aa, Artificial Sequence
  Description of Artificial Sequence: Synthetic peptide
  Seed: MAIYKQSQHMTEVVRRCPHRER (TP53 H179R)
  Core: VVRRCPHRE
  misc_feature (13)..(13): Xaa can be Ala, Cys, Glu, Phe, Gly, His, Ile, Leu, Met, Pro, Gln, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHMTEXVRXCXHRXR

SEQ ID NO: 28087 - protein, 23 aa, Artificial Sequence
  Description of Artificial Sequence: Synthetic peptide
  Seed: MAIYKQSQHMTEVVRRCPHRERC (TP53 H179R)
  Core: VVRRCPHRE
  misc_feature (13)..(13): Xaa can be Ala, Cys, Phe, Ile, Leu, Met, Val, Trp, or Tyr
  misc_feature (16)..(16): Xaa can be Ala, Cys, Glu, Phe, Gly, His, Ile, Lys, Leu, Met, Asn, Gln, Arg, Ser, Thr, Val, Trp, or Ty r
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHMTEXVRXCXHRXRC

SEQ ID NO: 28088 - protein, 23 aa, Artificial Sequence
  Description of Artificial Sequence: Synthetic peptide
  Seed: MAIYKQSQHMTEVVRRCPHRERC (TP53 H179R)
  Core: VRRCPHRER
  misc_feature (14)..(14): Xaa can be Phe, Ile, Leu, Met, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Gly, His, Ile, Lys, Asn, Pro, Gln, Arg, Ser, Thr, Val, or Trp
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHMTEVXRRXPXREXC

SEQ ID NO: 28089 - protein, 24 aa, Artificial Sequence
  Description of Artificial Sequence: Synthetic peptide
  Seed: MAIYKQSQHMTEVVRRCPHRERCS (TP53 H179R)
  Core: VVRRCPHRE
  misc_feature (13)..(13): Xaa can be Ala, Cys, Phe, His, Ile, Leu, Met, Asn, Gln, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHMTEXVRXCXHRXRCS

SEQ ID NO: 28090 - protein, 24 aa, Artificial Sequence
  Description of Artificial Sequence: Synthetic peptide
  Seed: MAIYKQSQHMTEVVRRCPHRERCS (TP53 H179R)
  Core: VRRCPHRER
  misc_feature (14)..(14): Xaa can be Cys, Phe, Ile, Leu, Met, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHMTEVXRRXPXREXCS

SEQ ID NO: 28091 - protein, 25 aa, Artificial Sequence
  Description of Artificial Sequence: Synthetic peptide
  Seed: MAIYKQSQHMTEVVRRCPHRERCSD (TP53 H179R)
  Core: VVRRCPHRE
  misc_feature (13)..(13): Xaa can be Phe, Ile, Leu, Met, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHMTEXVRXCXHRXRCSD

SEQ ID NO: 28092 - protein, 25 aa, Artificial Sequence
  Description of Artificial Sequence: Synthetic peptide
  Seed: MAIYKQSQHMTEVVRRCPHRERCSD (TP53 H179R)
  Core: VRRCPHRER
  misc_feature (14)..(14): Xaa can be Ala, Cys, Phe, Gly, Ile, Leu, Met, Pro, Gln, Thr, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHMTEVXRRXPXREXCSD

SEQ ID NO: 28093 - protein, 15 aa, Artificial Sequence
  Description of Artificial Sequence: Synthetic peptide
  Seed: MTEVVRRCPHRERCS (TP53 H179R)
  Core: VRRCPHRER
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
MTEVXRRXPXREXCS

SEQ ID NO: 28094 - protein, 15 aa, Artificial Sequence
  Description of Artificial Sequence: Synthetic peptide
  Seed: QHMTEVVRRCPHRER (TP53 H179R)
  Core: VVRRCPHRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QHMTEXVRXCXHRXR

SEQ ID NO: 28095 - protein, 15 aa, Artificial Sequence
  Description of Artificial Sequence: Synthetic peptide
  Seed: QHMTEVVRRCPHRER (TP53 H179R)
  Core: VRRCPHRER
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Asp, Glu, Gly, His, Ile, Lys, Leu, Asn, Pro, Gln, Arg, Ser, Thr, or Val
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QHMTEVXRRXPXREX

SEQ ID NO: 28096 - protein, 16 aa, Artificial Sequence
  Description of Artificial Sequence: Synthetic peptide
  Seed: QHMTEVVRRCPHRERC (TP53 H179R)
  Core: VRRCPHRER
  misc_feature (7)..(7): Xaa can be Cys, Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Asp, Glu, Phe, His, Ile, Lys, Leu, Asn, Pro, Gln, Arg, Ser, Thr, Val, or Trp
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QHMTEVXRRXPXREXC

SEQ ID NO: 28097 - protein, 17 aa, Artificial Sequence
  Description of Artificial Sequence: Synthetic peptide
  Seed: QHMTEVVRRCPHRERCS (TP53 H179R)
  Core: VRRCPHRER
  misc_feature (7)..(7): Xaa can be Ala, Cys, Phe, Gly, His, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QHMTEVXRRXPXREXCS

SEQ ID NO: 28098 - protein, 20 aa, Artificial Sequence
  Description of Artificial Sequence: Synthetic peptide
  Seed: QHMTEVVRRCPHRERCSDSD (TP53 H179R)
  Core: VRRCPHRER
  misc_feature (7)..(7): Xaa can be Ala, Cys, Phe, Gly, His, Ile, Lys, Leu, Met, Asn, Pro, Gln, Arg, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QHMTEVXRRXPXREXCSDSD

SEQ ID NO: 28099 - protein, 23 aa, Artificial Sequence
  Description of Artificial Sequence: Synthetic peptide
  Seed: QHMTEVVRRCPHRERCSDSDGLA (TP53 H179R)
  Core: VRRCPHRER
  misc_feature (7)..(7): Xaa can be Ala, Cys, Phe, Gly, His, Ile, Leu, Met, Asn, Gln, Ser, Thr, Val, Trp, or Tyr
  misc_feature (10)..(10): Xaa can be Ala, Cys, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QHMTEVXRRXPXREXCSDSDGLA

SEQ ID NO: 28100 - protein, 24 aa, Artificial Sequence
  Description of Artificial Sequence: Synthetic peptide
  Seed: QHMTEVVRRCPHRERCSDSDGLAP (TP53 H179R)
  Core: VRRCPHRER
  misc_feature (7)..(7): Xaa can be Ala, Cys, Phe, Gly, His, Ile, Leu, Met, Asn, Gln, Ser, Thr, Val, Trp, or Tyr
  misc_feature (10)..(10): Xaa can be Ala, Cys, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QHMTEVXRRXPXREXCSDSDGLAP

SEQ ID NO: 28101 - protein, 25 aa, Artificial Sequence
  Description of Artificial Sequence: Synthetic peptide
  Seed: QHMTEVVRRCPHRERCSDSDGLAPP (TP53 H179R)
  Core: VRRCPHRER
  misc_feature (7)..(7): Xaa can be Ala, Cys, Phe, Gly, His, Ile, Leu, Met, Asn, Pro, Gln, Ser, Thr, Val, Trp, or Tyr
  misc_feature (10)..(10): Xaa can be Ala, Cys, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QHMTEVXRRXPXREXCSDSDGLAPP

SEQ ID NO: 28102 - protein, 17 aa, Artificial Sequence
  Description of Artificial Sequence: Synthetic peptide
  Seed: QSQHMTEVVRRCPHRER (TP53 H179R)
  Core: VVRRCPHRE
  misc_feature (8)..(8): Xaa can be Ala, Cys, Phe, Gly, Ile, Leu, Met, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QSQHMTEXVRXCXHRXR

SEQ ID NO: 28103 - protein, 19 aa, Artificial Sequence
  Description of Artificial Sequence: Synthetic peptide
  Seed: QSQHMTEVVRRCPHRERCS (TP53 H179R)
  Core: VRRCPHRER
  misc_feature (9)..(9): Xaa can be Cys, Phe, Ile, Leu, Met, Val, Trp, or Tyr
  misc_feature (12)..(12): Xaa can be Ala, Cys, Glu, Phe, Gly, His, Ile, Lys, Leu, Met, Asn, Gln, Arg, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QSQHMTEVXRRXPXREXCS

SEQ ID NO: 28104 - protein, 20 aa, Artificial Sequence
  Description of Artificial Sequence: Synthetic peptide
  Seed: QSQHMTEVVRRCPHRERCSD (TP53 H179R)
  Core: VVRRCPHRE
  misc_feature (8)..(8): Xaa can be Phe, Ile, Leu, Met, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QSQHMTEXVRXCXHRXRCSD

SEQ ID NO: 28105 - protein, 20 aa, Artificial Sequence
  Description of Artificial Sequence: Synthetic peptide
  Seed: QSQHMTEVVRRCPHRERCSD (TP53 H179R)
  Core: VRRCPHRER
  misc_feature (9)..(9): Xaa can be Ala, Cys, Phe, Gly, His, Ile, Leu, Met, Pro, Gln, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QSQHMTEVXRRXPXREXCSD

SEQ ID NO: 28106 - protein, 21 aa, Artificial Sequence
  Description of Artificial Sequence: Synthetic peptide
  Seed: QSQHMTEVVRRCPHRERCSDS (TP53 H179R)
  Core: VRRCPHRER
  misc_feature (9)..(9): Xaa can be Ala, Cys, Phe, Gly, His, Ile, Leu, Met, Asn, Pro, Gln, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QSQHMTEVXRRXPXREXCSDS

SEQ ID NO: 28107 - protein, 22 aa, Artificial Sequence
  Description of Artificial Sequence: Synthetic peptide
  Seed: QSQHMTEVVRRCPHRERCSDSD (TP53 H179R)
  Core: VRRCPHRER
  misc_feature (9)..(9): Xaa can be Ala, Cys, Phe, Gly, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QSQHMTEVXRRXPXREXCSDSD

SEQ ID NO: 28108 - protein, 23 aa, Artificial Sequence
  Description of Artificial Sequence: Synthetic peptide
  Seed: QSQHMTEVVRRCPHRERCSDSDG (TP53 H179R)
  Core: VRRCPHRER
  misc_feature (9)..(9): Xaa can be Ala, Cys, Phe, Gly, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QSQHMTEVXRRXPXREXCSDSDG

SEQ ID NO: 28109 - protein, 24 aa, Artificial Sequence
  Description of Artificial Sequence: Synthetic peptide
  Seed: QSQHMTEVVRRCPHRERCSDSDGL (TP53 H179R)
  Core: VRRCPHRER
  misc_feature (9)..(9): Xaa can be Ala, Cys, Phe, Gly, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QSQHMTEVXRRXPXREXCSDSDGL

SEQ ID NO: 28110 - protein, 25 aa, Artificial Sequence
  Description of Artificial Sequence: Synthetic peptide
  Seed: QSQHMTEVVRRCPHRERCSDSDGLA (TP53 H179R)
  Core: VRRCPHRER
  misc_feature (9)..(9): Xaa can be Ala, Cys, Phe, Gly, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QSQHMTEVXRRXPXREXCSDSDGLA

SEQ ID NO: 28111 - protein, 24 aa, Artificial Sequence
  Description of Artificial Sequence: Synthetic peptide
  Seed: RAMAIYKQSQHMTEVVRRCPHRER (TP53 H179R)
  Core: VVRRCPHRE
  misc_feature (15)..(15): Xaa can be Phe, Ile, Leu, Met, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Gly, His, Ile, Lys, Leu, Met, Asn, Pro, Gln, Arg, Ser, Thr, Val, or Ty r
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RAMAIYKQSQHMTEXVRXCXHRXR

SEQ ID NO: 28112 - protein, 25 aa, Artificial Sequence
  Description of Artificial Sequence: Synthetic peptide
  Seed: RAMAIYKQSQHMTEVVRRCPHRERC (TP53 H179R)
  Core: VRRCPHRER
  misc_feature (16)..(16): Xaa can be Phe, Ile, Leu, Met, Val, Trp, or Tyr
  misc_feature (19)..(19): Xaa can be Ala, Cys, Asp, Glu, Phe, Gly, His, Ile, Lys, Leu, Met, Asn, Gln, Arg, Ser, Thr, Val, Trp, or Tyr
  misc_feature (21)..(21): Xaa can be Ala, Cys, Asp, Glu, Gly, His, Ile, Lys, Asn, Pro, Gln, Arg, Ser, Thr, Val, or Trp
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RAMAIYKQSQHMTEVXRRXPXREXC

SEQ ID NO: 28113 - protein, 17 aa, Artificial Sequence
  Description of Artificial Sequence: Synthetic peptide
  Seed: SQHMTEVVRRCPHRERC (TP53 H179R)
  Core: VRRCPHRER
  misc_feature (8)..(8): Xaa can be Ala, Cys, Phe, Ile, Leu, Met, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Gly, His, Ile, Lys, Leu, Asn, Pro, Gln, Arg, Ser, Thr, Val, or Trp
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQHMTEVXRRXPXREXC

SEQ ID NO: 28114 - protein, 19 aa, Artificial Sequence
  Description of Artificial Sequence: Synthetic peptide
  Seed: SQHMTEVVRRCPHRERCSD (TP53 H179R)
  Core: VRRCPHRER
  misc_feature (8)..(8): Xaa can be Ala, Cys, Phe, Gly, Ile, Leu, Met, Gln, Thr, Val, Trp, or Tyr
  misc_feature (11)..(11): Xaa can be Ala, Cys, Glu, Phe, Gly, His, Ile, Lys, Leu, Met, Asn, Gln, Arg, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQHMTEVXRRXPXREXCSD

SEQ ID NO: 28115 - protein, 20 aa, Artificial Sequence
  Description of Artificial Sequence: Synthetic peptide
  Seed: SQHMTEVVRRCPHRERCSDS (TP53 H179R)
  Core: VVRRCPHRE
  misc_feature (7)..(7): Xaa can be Phe, Ile, Leu, Met, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQHMTEXVRXCXHRXRCSDS

SEQ ID NO: 28116 - protein, 20 aa, Artificial Sequence
  Description of Artificial Sequence: Synthetic peptide
  Seed: SQHMTEVVRRCPHRERCSDS (TP53 H179R)
  Core: VRRCPHRER
  misc_feature (8)..(8): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQHMTEVXRRXPXREXCSDS

SEQ ID NO: 28117 - protein, 21 aa, Artificial Sequence
  Description of Artificial Sequence: Synthetic peptide
  Seed: SQHMTEVVRRCPHRERCSDSD (TP53 H179R)
  Core: VRRCPHRER
  misc_feature (8)..(8): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQHMTEVXRRXPXREXCSDSD

SEQ ID NO: 28118 - protein, 22 aa, Artificial Sequence
  Description of Artificial Sequence: Synthetic peptide
  Seed: SQHMTEVVRRCPHRERCSDSDG (TP53 H179R)
  Core: VRRCPHRER
  misc_feature (8)..(8): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQHMTEVXRRXPXREXCSDSDG

SEQ ID NO: 28119 - protein, 23 aa, Artificial Sequence
  Description of Artificial Sequence: Synthetic peptide
  Seed: SQHMTEVVRRCPHRERCSDSDGL (TP53 H179R)
  Core: VRRCPHRER
  misc_feature (8)..(8): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQHMTEVXRRXPXREXCSDSDGL

SEQ ID NO: 28120 - protein, 24 aa, Artificial Sequence
  Description of Artificial Sequence: Synthetic peptide
  Seed: SQHMTEVVRRCPHRERCSDSDGLA (TP53 H179R)
  Core: VRRCPHRER
  misc_feature (8)..(8): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQHMTEVXRRXPXREXCSDSDGLA

SEQ ID NO: 28121 - protein, 25 aa, Artificial Sequence
  Description of Artificial Sequence: Synthetic peptide
  Seed: SQHMTEVVRRCPHRERCSDSDGLAP (TP53 H179R)
  Core: VRRCPHRER
  misc_feature (8)..(8): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQHMTEVXRRXPXREXCSDSDGLAP

SEQ ID NO: 28122 - protein, 15 aa, Artificial Sequence
  Description of Artificial Sequence: Synthetic peptide
  Seed: TEVVRRCPHRERCSD (TP53 H179R)
  Core: VRRCPHRER
  misc_feature (4)..(4): Xaa can be Ala, Cys, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXRRXPXREXCSD

SEQ ID NO: 28123 - protein, 20 aa, Artificial Sequence
  Description of Artificial Sequence: Synthetic peptide
  Seed: YKQSQHMTEVVRRCPHRERC (TP53 H179R)
  Core: VVRRCPHRE
  misc_feature (10)..(10): Xaa can be Ala, Cys, Phe, His, Ile, Leu, Met, Gln, Arg, Thr, Val, Trp, or Tyr
  misc_feature (13)..(13): Xaa can be Ala, Cys, Glu, Phe, Gly, His, Ile, Lys, Leu, Met, Asn, Gln, Arg, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YKQSQHMTEXVRXCXHRXRC

SEQ ID NO: 28124 - protein, 21 aa, Artificial Sequence
  Description of Artificial Sequence: Synthetic peptide
  Seed: YKQSQHMTEVVRRCPHRERCS (TP53 H179R)
  Core: VRRCPHRER
  misc_feature (11)..(11): Xaa can be Ala, Cys, Phe, Ile, Leu, Met, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKQSQHMTEVXRRXPXREXCS

SEQ ID NO: 28125 - protein, 22 aa, Artificial Sequence
  Description of Artificial Sequence: Synthetic peptide
  Seed: YKQSQHMTEVVRRCPHRERCSD (TP53 H179R)
  Core: VRRCPHRER
  misc_feature (11)..(11): Xaa can be Ala, Cys, Phe, Gly, His, Ile, Leu, Met, Pro, Gln, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKQSQHMTEVXRRXPXREXCSD

SEQ ID NO: 28126 - protein, 23 aa, Artificial Sequence
  Description of Artificial Sequence: Synthetic peptide
  Seed: YKQSQHMTEVVRRCPHRERCSDS (TP53 H179R)
  Core: VVRRCPHRE
  misc_feature (10)..(10): Xaa can be Phe, Ile, Leu, Met, Val, Trp, or Tyr
  misc_feature (13)..(13): Xaa can be Ala, Cys, Glu, Phe, Gly, His, Ile, Lys, Leu, Met, Asn, Gln, Arg, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YKQSQHMTEXVRXCXHRXRCSDS

SEQ ID NO: 28127 - protein, 23 aa, Artificial Sequence
  Description of Artificial Sequence: Synthetic peptide
  Seed: YKQSQHMTEVVRRCPHRERCSDS (TP53 H179R)
  Core: VRRCPHRER
  misc_feature (11)..(11): Xaa can be Ala, Cys, Phe, Gly, His, Ile, Leu, Met, Pro, Gln, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKQSQHMTEVXRRXPXREXCSDS

SEQ ID NO: 28128 - protein, 24 aa, Artificial Sequence
  Description of Artificial Sequence: Synthetic peptide
  Seed: YKQSQHMTEVVRRCPHRERCSDSD (TP53 H179R)
  Core: VVRRCPHRE
  misc_feature (10)..(10): Xaa can be Phe, Ile, Leu, Met, Arg, Val, Trp, or Tyr
  misc_feature (13)..(13): Xaa can be Ala, Cys, Glu, Phe, Gly, His, Ile, Lys, Leu, Met, Asn, Gln, Arg, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YKQSQHMTEXVRXCXHRXRCSDSD

SEQ ID NO: 28129 - protein, 24 aa, Artificial Sequence
  Description of Artificial Sequence: Synthetic peptide
  Seed: YKQSQHMTEVVRRCPHRERCSDSD (TP53 H179R)
  Core: VRRCPHRER
  misc_feature (11)..(11): Xaa can be Ala, Cys, Phe, Gly, His, Ile, Leu, Met, Pro, Gln, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKQSQHMTEVXRRXPXREXCSDSD

SEQ ID NO: 28130 - protein, 25 aa, Artificial Sequence
  Description of Artificial Sequence: Synthetic peptide
  Seed: YKQSQHMTEVVRRCPHRERCSDSDG (TP53 H179R)
  Core: VVRRCPHRE
  misc_feature (10)..(10): Xaa can be Phe, Ile, Leu, Met, Arg, Val, Trp, or Tyr
  misc_feature (13)..(13): Xaa can be Ala, Cys, Glu, Phe, Gly, His, Ile, Lys, Leu, Met, Asn, Gln, Arg, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YKQSQHMTEXVRXCXHRXRCSDSDG

SEQ ID NO: 28131 - protein, 25 aa, Artificial Sequence
  Description of Artificial Sequence: Synthetic peptide
  Seed: YKQSQHMTEVVRRCPHRERCSDSDG (TP53 H179R)
  Core: VRRCPHRER
  misc_feature (11)..(11): Xaa can be Ala, Cys, Phe, Gly, His, Ile, Leu, Met, Pro, Gln, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKQSQHMTEVXRRXPXREXCSDSDG

SEQ ID NO: 28132 - protein, 25 aa, Artificial Sequence
  Description of Artificial Sequence: Synthetic peptide
  Seed: CPVQLWVDSTPPPGTRVLAMAIYKQ (TP53 R158L)
  Core: VLAMAIYKQ
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
CPVQLWVDSTPPPGTRXLAXAXYKX

SEQ ID NO: 28133 - protein, 15 aa, Artificial Sequence
  Description of Artificial Sequence: Synthetic peptide
  Seed: DSTPPPGTRVLAMAI (TP53 R158L)
  Core: PPGTRVLAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTPXPGXRXLAXAI

SEQ ID NO: 28134 - protein, 16 aa, Artificial Sequence
  Description of Artificial Sequence: Synthetic peptide
  Seed: DSTPPPGTRVLAMAIY (TP53 R158L)
  Core: PPGTRVLAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTPXPGXRXLAXAIY

SEQ ID NO: 28135 - protein, 17 aa, Artificial Sequence
  Description of Artificial Sequence: Synthetic peptide
  Seed: DSTPPPGTRVLAMAIYK (TP53 R158L)
  Core: PPGTRVLAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, or Trp
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTPXPGXRXLAXAIYK

SEQ ID NO: 28136 - protein, 17 aa, Artificial Sequence
  Description of Artificial Sequence: Synthetic peptide
  Seed: DSTPPPGTRVLAMAIYK (TP53 R158L)
  Core: GTRVLAMAI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPXTRXLXMAXYK

SEQ ID NO: 28137 - protein, 18 aa, Artificial Sequence
  Description of Artificial Sequence: Synthetic peptide
  Seed: DSTPPPGTRVLAMAIYKQ (TP53 R158L)
  Core: VLAMAIYKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Glu, Phe, Gly, His, Ile, Leu, Met, Asn, Gln, Ser, Thr, Val, Trp, or Tyr
  misc_feature (15)..(15): Xaa can be Ala, Cys, Asp, Glu, Phe, Gly, His, Ile, Leu, Met, Asn, Pro, Gln, Ser, Thr, Val, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPGTRXLAXAXYKX

SEQ ID NO: 28138 - protein, 19 aa, Artificial Sequence
  Description of Artificial Sequence: Synthetic peptide
  Seed: DSTPPPGTRVLAMAIYKQS (TP53 R158L)
  Core: PPGTRVLAM
  misc_feature (5)..(5): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Cys, Asp, Phe, Gly, His, Ile, Leu, Met, Asn, Gln, Ser, Thr, or Val
  misc_feature (10)..(10): Xaa can be Ala, Cys, Asp, Glu, Phe, His, Ile, Leu, Met, Asn, Pro, Gln, Ser, Thr, Val, or Trp
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTPXPGXRXLAXAIYKQS

SEQ ID NO: 28139 - protein, 19 aa, Artificial Sequence
  Description of Artificial Sequence: Synthetic peptide
  Seed: DSTPPPGTRVLAMAIYKQS (TP53 R158L)
  Core: GTRVLAMAI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPXTRXLXMAXYKQS

SEQ ID NO: 28140 - protein, 19 aa, Artificial Sequence
  Description of Artificial Sequence: Synthetic peptide
  Seed: DSTPPPGTRVLAMAIYKQS (TP53 R158L)
  Core: VLAMAIYKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPGTRXLAXAXYKXS

SEQ ID NO: 28141 - protein, 20 aa, Artificial Sequence
  Description of Artificial Sequence: Synthetic peptide
  Seed: DSTPPPGTRVLAMAIYKQSQ (TP53 R158L)
  Core: GTRVLAMAI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPXTRXLXMAXYKQSQ

SEQ ID NO: 28142 - protein, 20 aa, Artificial Sequence
  Description of Artificial Sequence: Synthetic peptide
  Seed: DSTPPPGTRVLAMAIYKQSQ (TP53 R158L)
  Core: RVLAMAIYK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPGTXVLXMXIYXQSQ

SEQ ID NO: 28143 - protein, 20 aa, Artificial Sequence
  Description of Artificial Sequence: Synthetic peptide
  Seed: DSTPPPGTRVLAMAIYKQSQ (TP53 R158L)
  Core: VLAMAIYKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPGTRXLAXAXYKXSQ

SEQ ID NO: 28144 - protein, 21 aa, Artificial Sequence
  Description of Artificial Sequence: Synthetic peptide
  Seed: DSTPPPGTRVLAMAIYKQSQH (TP53 R158L)
  Core: VLAMAIYKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPGTRXLAXAXYKXSQH

SEQ ID NO: 28145 - protein, 22 aa, Artificial Sequence
  Description of Artificial Sequence: Synthetic peptide
  Seed: DSTPPPGTRVLAMAIYKQSQHM (TP53 R158L)
  Core: VLAMAIYKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPGTRXLAXAXYKXSQHM

SEQ ID NO: 28146 - protein, 23 aa, Artificial Sequence
  Description of Artificial Sequence: Synthetic peptide
  Seed: DSTPPPGTRVLAMAIYKQSQHMT (TP53 R158L)
  Core: VLAMAIYKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPGTRXLAXAXYKXSQHMT

SEQ ID NO: 28147 - protein, 24 aa, Artificial Sequence
  Description of Artificial Sequence: Synthetic peptide
  Seed: DSTPPPGTRVLAMAIYKQSQHMTE (TP53 R158L)
  Core: VLAMAIYKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPGTRXLAXAXYKXSQHMTE

SEQ ID NO: 28148 - protein, 25 aa, Artificial Sequence
  Description of Artificial Sequence: Synthetic peptide
  Seed: DSTPPPGTRVLAMAIYKQSQHMTEV (TP53 R158L)
  Core: GTRVLAMAI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPXTRXLXMAXYKQSQHMTEV

SEQ ID NO: 28149 - protein, 25 aa, Artificial Sequence
  Description of Artificial Sequence: Synthetic peptide
  Seed: DSTPPPGTRVLAMAIYKQSQHMTEV (TP53 R158L)
  Core: RVLAMAIYK
  misc_feature (9)..(9): Xaa can be Glu, Phe, His, Ile, Lys, Leu, Met, Asn, Gln, Arg, Val, Trp, or Tyr
  misc_feature (12)..(12): Xaa can be Ala, Cys, Asp, Glu, Phe, Gly, His, Ile, Lys, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, or Tyr
DSTPPPGTXVLXMXIYXQSQHMTEV

SEQ ID NO: 28150 - protein, 25 aa, Artificial Sequence
  Description of Artificial Sequence: Synthetic peptide
  Seed: DSTPPPGTRVLAMAIYKQSQHMTEV (TP53 R158L)
  Core: VLAMAIYKQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSTPPPGTRXLAXAXYKXSQHMTEV

SEQ ID NO: 28151 - protein, 13 aa, Artificial Sequence
  Description of Artificial Sequence: Synthetic peptide
  Seed: GTRVLAMAIYKQS (TP53 R158L)
  Core: RVLAMAIYK
  misc_feature (3)..(3): Xaa can be Phe, Arg, or Tyr
  misc_feature (6)..(6): Xaa can be Ala, Asp, Glu, Phe, Gly, His, Ile, Lys, Leu, Met, Asn, Gln, Ser, Thr, Val, or Trp
  misc_feature (8)..(8): Xaa can be Ala, Glu, Phe, His, Ile, Leu, Met, Pro, Ser, Thr, Val, or Tyr
  misc_feature (11)..(11): Xaa can be Ala, Asp, Glu, Phe, Gly, His, Ile, Lys, Leu, Met, Asn, Pro, Gln, Arg, Ser, Thr, Val, or Ty r
GTXVLXMXIYXQS

SEQ ID NO: 28152 - protein, 13 aa, Artificial Sequence
  Description of Artificial Sequence: Synthetic peptide
  Seed: GTRVLAMAIYKQS (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXS

SEQ ID NO: 28153 - protein, 14 aa, Artificial Sequence
  Description of Artificial Sequence: Synthetic peptide
  Seed: GTRVLAMAIYKQSQ (TP53 R158L)
  Core: RVLAMAIYK
  misc_feature (3)..(3): Xaa can be Glu, Phe, His, Ile, Lys, Leu, Met, Gln, Arg, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, or Tyr
GTXVLXMXIYXQSQ

SEQ ID NO: 28154 - protein, 14 aa, Artificial Sequence
  Description of Artificial Sequence: Synthetic peptide
  Seed: GTRVLAMAIYKQSQ (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQ

SEQ ID NO: 28155 - protein, 15 aa, Artificial Sequence
  Description of Artificial Sequence: Synthetic peptide
  Seed: GTRVLAMAIYKQSQH (TP53 R158L)
  Core: RVLAMAIYK
  misc_feature (3)..(3): Xaa can be Ala, Glu, Phe, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, or Tyr
GTXVLXMXIYXQSQH

SEQ ID NO: 28156 - protein, 15 aa, Artificial Sequence
  Description of Artificial Sequence: Synthetic peptide
  Seed: GTRVLAMAIYKQSQH (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQH

SEQ ID NO: 28157 - protein, 16 aa, Artificial Sequence
  Description of Artificial Sequence: Synthetic peptide
  Seed: GTRVLAMAIYKQSQHM (TP53 R158L)
  Core: RVLAMAIYK
  misc_feature (3)..(3): Xaa can be Glu, Phe, His, Ile, Lys, Leu, Met, Asn, Pro, Gln, Arg, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, or Tyr
GTXVLXMXIYXQSQHM

SEQ ID NO: 28158 - protein, 16 aa, Artificial Sequence
  Description of Artificial Sequence: Synthetic peptide
  Seed: GTRVLAMAIYKQSQHM (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHM

SEQ ID NO: 28159 - protein, 17 aa, Artificial Sequence
  Description of Artificial Sequence: Synthetic peptide
  Seed: GTRVLAMAIYKQSQHMT (TP53 R158L)
  Core: RVLAMAIYK
  misc_feature (3)..(3): Xaa can be Ala, Glu, Phe, His, Ile, Lys, Leu, Met, Gln, Arg, Ser, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, or Tyr
GTXVLXMXIYXQSQHMT

SEQ ID NO: 28160 - protein, 17 aa, Artificial Sequence
  Description of Artificial Sequence: Synthetic peptide
  Seed: GTRVLAMAIYKQSQHMT (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHMT

SEQ ID NO: 28161 - protein, 18 aa, Artificial Sequence
  Description of Artificial Sequence: Synthetic peptide
  Seed: GTRVLAMAIYKQSQHMTE (TP53 R158L)
  Core: RVLAMAIYK
  misc_feature (3)..(3): Xaa can be Phe, Lys, or Arg
  misc_feature (6)..(6): Xaa can be Ala, Glu, Gly, His, Ile, Leu, Met, Asn, Gln, Ser, Thr, or Val
  misc_feature (8)..(8): Xaa can be Ala, Gly, Ile, Pro, Ser, Thr, or Val
  misc_feature (11)..(11): Xaa can be Ala, Asp, Glu, Gly, His, Ile, Lys, Leu, Met, Asn, Pro, Gln, Arg, Ser, Thr, or Val
GTXVLXMXIYXQSQHMTE

SEQ ID NO: 28162 - protein, 18 aa, Artificial Sequence
  Description of Artificial Sequence: Synthetic peptide
  Seed: GTRVLAMAIYKQSQHMTE (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHMTE

SEQ ID NO: 28163 - protein, 19 aa, Artificial Sequence
  Description of Artificial Sequence: Synthetic peptide
  Seed: GTRVLAMAIYKQSQHMTEV (TP53 R158L)
  Core: RVLAMAIYK
  misc_feature (3)..(3): Xaa can be Phe, His, Ile, Lys, Leu, Met, Arg, or Tyr
  misc_feature (6)..(6): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Cys, Glu, Phe, Gly, Ile, Leu, Met, Asn, Pro, Ser, Thr, or Val
  misc_feature (11)..(11): Xaa can be Ala, Cys, Asp, Glu, Phe, Gly, His, Ile, Lys, Leu, Met, Asn, Pro, Gln, Arg, Ser, Thr, Val, or Tyr
GTXVLXMXIYXQSQHMTEV

SEQ ID NO: 28164 - protein, 19 aa, Artificial Sequence
  Description of Artificial Sequence: Synthetic peptide
  Seed: GTRVLAMAIYKQSQHMTEV (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHMTEV

SEQ ID NO: 28165 - protein, 20 aa, Artificial Sequence
  Description of Artificial Sequence: Synthetic peptide
  Seed: GTRVLAMAIYKQSQHMTEVV (TP53 R158L)
  Core: RVLAMAIYK
  misc_feature (3)..(3): Xaa can be Glu, Phe, His, Ile, Lys, Leu, Met, Pro, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, or Tyr
GTXVLXMXIYXQSQHMTEVV

SEQ ID NO: 28166 - protein, 20 aa, Artificial Sequence
  Description of Artificial Sequence: Synthetic peptide
  Seed: GTRVLAMAIYKQSQHMTEVV (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHMTEVV

SEQ ID NO: 28167 - protein, 21 aa, Artificial Sequence
  Description of Artificial Sequence: Synthetic peptide
  Seed: GTRVLAMAIYKQSQHMTEVVR (TP53 R158L)
  Core: RVLAMAIYK
  misc_feature (3)..(3): Xaa can be Phe, Lys, Arg, or Tyr
  misc_feature (6)..(6): Xaa can be Ala, Cys, Asp, Glu, Phe, Gly, His, Ile, Lys, Leu, Met, Asn, Pro, Gln, Ser, Thr, or Val
  misc_feature (8)..(8): Xaa can be Ala, Gly, Ile, Pro, Ser, Thr, or Val
  misc_feature (11)..(11): Xaa can be Ala, Asp, Glu, Phe, Gly, His, Ile, Lys, Leu, Met, Asn, Pro, Gln, Ser, Thr, Val, or Tyr
GTXVLXMXIYXQSQHMTEVVR

SEQ ID NO: 28168 - protein, 21 aa, Artificial Sequence
  Description of Artificial Sequence: Synthetic peptide
  Seed: GTRVLAMAIYKQSQHMTEVVR (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHMTEVVR

SEQ ID NO: 28169 - protein, 22 aa, Artificial Sequence
  Description of Artificial Sequence: Synthetic peptide
  Seed: GTRVLAMAIYKQSQHMTEVVRR (TP53 R158L)
  Core: RVLAMAIYK
  misc_feature (3)..(3): Xaa can be Phe, Lys, Arg, or Tyr
  misc_feature (6)..(6): Xaa can be Ala, Cys, Asp, Glu, Phe, Gly, His, Ile, Lys, Leu, Met, Asn, Pro, Gln, Ser, Thr, or Val
  misc_feature (8)..(8): Xaa can be Ala, Gly, Ile, Leu, Asn, Pro, Ser, Thr, or Val
  misc_feature (11)..(11): Xaa can be Ala, Asp, Glu, Phe, Gly, His, Ile, Lys, Leu, Met, Asn, Pro, Gln, Ser, Thr, Val, or Tyr
GTXVLXMXIYXQSQHMTEVVRR

SEQ ID NO: 28170 - protein, 22 aa, Artificial Sequence
  Description of Artificial Sequence: Synthetic peptide
  Seed: GTRVLAMAIYKQSQHMTEVVRR (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHMTEVVRR

SEQ ID NO: 28171 - protein, 23 aa, Artificial Sequence
  Description of Artificial Sequence: Synthetic peptide
  Seed: GTRVLAMAIYKQSQHMTEVVRRC (TP53 R158L)
  Core: RVLAMAIYK
  misc_feature (3)..(3): Xaa can be Phe, Lys, Met, Arg, or Tyr
  misc_feature (6)..(6): Xaa can be Ala, Cys, Asp, Glu, Phe, Gly, His, Ile, Lys, Leu, Met, Asn, Pro, Gln, Ser, Thr, or Val
  misc_feature (8)..(8): Xaa can be Ala, Gly, Ile, Leu, Asn, Pro, Ser, Thr, or Val
  misc_feature (11)..(11): Xaa can be Ala, Asp, Glu, Phe, Gly, His, Ile, Lys, Leu, Met, Asn, Pro, Gln, Ser, Thr, Val, or Tyr
GTXVLXMXIYXQSQHMTEVVRRC

SEQ ID NO: 28172 - protein, 23 aa, Artificial Sequence
  Description of Artificial Sequence: Synthetic peptide
  Seed: GTRVLAMAIYKQSQHMTEVVRRC (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHMTEVVRRC

SEQ ID NO: 28173 - protein, 24 aa, Artificial Sequence
  Description of Artificial Sequence: Synthetic peptide
  Seed: GTRVLAMAIYKQSQHMTEVVRRCP (TP53 R158L)
  Core: RVLAMAIYK
  misc_feature (3)..(3): Xaa can be , or Arg
  misc_feature (6)..(6): Xaa can be Ala, Glu, Phe, Gly, His, Ile, Lys, Leu, Met, Asn, Pro, Gln, Ser, Thr, or Val
  misc_feature (8)..(8): Xaa can be Ala, Gly, Ile, Leu, Pro, Ser, Thr, or Val
  misc_feature (11)..(11): Xaa can be Ala, Asp, Glu, Gly, His, Ile, Lys, Leu, Met, Asn, Pro, Gln, Ser, Thr, Val, or Tyr
GTXVLXMXIYXQSQHMTEVVRRCP

SEQ ID NO: 28174 - protein, 24 aa, Artificial Sequence
  Description of Artificial Sequence: Synthetic peptide
  Seed: GTRVLAMAIYKQSQHMTEVVRRCP (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHMTEVVRRCP

SEQ ID NO: 28175 - protein, 25 aa, Artificial Sequence
  Description of Artificial Sequence: Synthetic peptide
  Seed: GTRVLAMAIYKQSQHMTEVVRRCPH (TP53 R158L)
  Core: RVLAMAIYK
  misc_feature (3)..(3): Xaa can be , or Arg
  misc_feature (6)..(6): Xaa can be Ala, Glu, Phe, Gly, His, Ile, Lys, Leu, Met, Asn, Pro, Gln, Ser, Thr, or Val
  misc_feature (8)..(8): Xaa can be Ala, Gly, Ile, Leu, Pro, Ser, Thr, or Val
  misc_feature (11)..(11): Xaa can be Ala, Asp, Glu, Phe, Gly, His, Ile, Lys, Leu, Met, Asn, Pro, Gln, Ser, Thr, Val, or Tyr
GTXVLXMXIYXQSQHMTEVVRRCPH

SEQ ID NO: 28176 - protein, 25 aa, Artificial Sequence
  Description of Artificial Sequence: Synthetic peptide
  Seed: GTRVLAMAIYKQSQHMTEVVRRCPH (TP53 R158L)
  Core: VLAMAIYKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTRXLAXAXYKXSQHMTEVVRRCPH

SEQ ID NO: 28177 - protein, 19 aa, Artificial Sequence
  Description of Artificial Sequence: Synthetic peptide
  Seed: LWVDSTPPPGTRVLAMAIY (TP53 R158L)
  Core: PPGTRVLAM
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Gly, Ile, Met, Asn, Ser, Thr, Val, or Trp
  misc_feature (13)..(13): Xaa can be Ala, Cys, Glu, Gly, Ile, Leu, Met, Asn, Pro, Ser, Thr, or Val
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
LWVDSTPXPGXRXLAXAIY

SEQ ID NO: 28178 - protein, 20 aa, Artificial Sequence
  Description of Artificial Sequence: Synthetic peptide
  Seed: LWVDSTPPPGTRVLAMAIYK (TP53 R158L)
  Core: PPGTRVLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Leu, Met, Asn, Pro, Gln, Ser, Thr, Val, or Trp
  misc_feature (13)..(13): Xaa can be Ala, Cys, Asp, Glu, Phe, Gly, Ile, Leu, Met, Asn, Pro, Ser, Thr, Val, or Trp
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPXPGXRXLAXAIYK

SEQ ID NO: 28179 - protein, 20 aa, Artificial Sequence
  Description of Artificial Sequence: Synthetic peptide
  Seed: LWVDSTPPPGTRVLAMAIYK (TP53 R158L)
  Core: GTRVLAMAI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPPPXTRXLXMAXYK

SEQ ID NO: 28180 - protein, 21 aa, Artificial Sequence
  Description of Artificial Sequence: Synthetic peptide
  Seed: LWVDSTPPPGTRVLAMAIYKQ (TP53 R158L)
  Core: RVLAMAIYK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Asp, Glu, Gly, His, Ile, Lys, Asn, Pro, Gln, Arg, Ser, Thr, or Val
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPPPGTXVLXMXIYXQ

SEQ ID NO: 28181 - protein, 21 aa, Artificial Sequence
  Description of Artificial Sequence: Synthetic peptide
  Seed: LWVDSTPPPGTRVLAMAIYKQ (TP53 R158L)
  Core: VLAMAIYKQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPPPGTRXLAXAXYKX

SEQ ID NO: 28182 - protein, 22 aa, Artificial Sequence
  Description of Artificial Sequence: Synthetic peptide
  Seed: LWVDSTPPPGTRVLAMAIYKQS (TP53 R158L)
  Core: PPGTRVLAM
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Gly, Ile, Ser, Thr, Val, or Trp
  misc_feature (13)..(13): Xaa can be Ala, Cys, Asp, Glu, Gly, Ile, Leu, Met, Asn, Pro, Ser, Thr, or Val
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPXPGXRXLAXAIYKQS

SEQ ID NO: 28183 - protein, 22 aa, Artificial Sequence
  Description of Artificial Sequence: Synthetic peptide
  Seed: LWVDSTPPPGTRVLAMAIYKQS (TP53 R158L)
  Core: RVLAMAIYK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Gly, His, Ile, Lys, Leu, Met, Asn, Pro, Gln, Arg, Ser, Thr, Val, or Ty r
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPPPGTXVLXMXIYXQS

SEQ ID NO: 28184 - protein, 22 aa, Artificial Sequence
  Description of Artificial Sequence: Synthetic peptide
  Seed: LWVDSTPPPGTRVLAMAIYKQS (TP53 R158L)
  Core: VLAMAIYKQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPPPGTRXLAXAXYKXS

SEQ ID NO: 28185 - protein, 23 aa, Artificial Sequence
  Description of Artificial Sequence: Synthetic peptide
  Seed: LWVDSTPPPGTRVLAMAIYKQSQ (TP53 R158L)
  Core: PPGTRVLAM
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Gly, Ile, Ser, Thr, Val, or Trp
  misc_feature (13)..(13): Xaa can be Ala, Cys, Asp, Glu, Gly, Ile, Leu, Met, Asn, Pro, Ser, Thr, or Val
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPXPGXRXLAXAIYKQSQ

SEQ ID NO: 28186 - protein, 23 aa, Artificial Sequence
  Description of Artificial Sequence: Synthetic peptide
  Seed: LWVDSTPPPGTRVLAMAIYKQSQ (TP53 R158L)
  Core: RVLAMAIYK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPPPGTXVLXMXIYXQSQ

SEQ ID NO: 28187 - protein, 23 aa, Artificial Sequence
  Description of Artificial Sequence: Synthetic peptide
  Seed: LWVDSTPPPGTRVLAMAIYKQSQ (TP53 R158L)
  Core: VLAMAIYKQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPPPGTRXLAXAXYKXSQ

SEQ ID NO: 28188 - protein, 24 aa, Artificial Sequence
  Description of Artificial Sequence: Synthetic peptide
  Seed: LWVDSTPPPGTRVLAMAIYKQSQH (TP53 R158L)
  Core: RVLAMAIYK
  misc_feature (12)..(12): Xaa can be Cys, Glu, Phe, His, Ile, Lys, Leu, Met, Gln, Arg, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, or Tyr
LWVDSTPPPGTXVLXMXIYXQSQH

SEQ ID NO: 28189 - protein, 24 aa, Artificial Sequence
  Description of Artificial Sequence: Synthetic peptide
  Seed: LWVDSTPPPGTRVLAMAIYKQSQH (TP53 R158L)
  Core: VLAMAIYKQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPPPGTRXLAXAXYKXSQH

SEQ ID NO: 28190 - protein, 25 aa, Artificial Sequence
  Description of Artificial Sequence: Synthetic peptide
  Seed: LWVDSTPPPGTRVLAMAIYKQSQHM (TP53 R158L)
  Core: RVLAMAIYK
  misc_feature (12)..(12): Xaa can be Cys, Asp, Glu, Phe, His, Ile, Lys, Leu, Met, Pro, Gln, Arg, Ser, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, or Tyr
LWVDSTPPPGTXVLXMXIYXQSQHM

SEQ ID NO: 28191 - protein, 25 aa, Artificial Sequence
  Description of Artificial Sequence: Synthetic peptide
  Seed: LWVDSTPPPGTRVLAMAIYKQSQHM (TP53 R158L)
  Core: VLAMAIYKQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LWVDSTPPPGTRXLAXAXYKXSQHM

SEQ ID NO: 28192 - protein, 13 aa, Artificial Sequence
  Description of Artificial Sequence: Synthetic peptide
  Seed: PGTRVLAMAIYKQ (TP53 R158L)
  Core: VLAMAIYKQ
  misc_feature (5)..(5): Xaa can be Ala, Cys, Asp, Glu, Phe, Gly, His, Ile, Leu, Met, Asn, Gln, Arg, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKX

SEQ ID NO: 28193 - protein, 14 aa, Artificial Sequence
  Description of Artificial Sequence: Synthetic peptide
  Seed: PGTRVLAMAIYKQS (TP53 R158L)
  Core: RVLAMAIYK
  misc_feature (4)..(4): Xaa can be Ala, Phe, His, Ile, Lys, Leu, Met, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
PGTXVLXMXIYXQS

SEQ ID NO: 28194 - protein, 14 aa, Artificial Sequence
  Description of Artificial Sequence: Synthetic peptide
  Seed: PGTRVLAMAIYKQS (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXS

SEQ ID NO: 28195 - protein, 15 aa, Artificial Sequence
  Description of Artificial Sequence: Synthetic peptide
  Seed: PGTRVLAMAIYKQSQ (TP53 R158L)
  Core: RVLAMAIYK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGTXVLXMXIYXQSQ

SEQ ID NO: 28196 - protein, 15 aa, Artificial Sequence
  Description of Artificial Sequence: Synthetic peptide
  Seed: PGTRVLAMAIYKQSQ (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQ

SEQ ID NO: 28197 - protein, 16 aa, Artificial Sequence
  Description of Artificial Sequence: Synthetic peptide
  Seed: PGTRVLAMAIYKQSQH (TP53 R158L)
  Core: RVLAMAIYK
  misc_feature (4)..(4): Xaa can be Ala, Cys, Glu, Phe, His, Ile, Lys, Leu, Met, Asn, Pro, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGTXVLXMXIYXQSQH

SEQ ID NO: 28198 - protein, 16 aa, Artificial Sequence
  Description of Artificial Sequence: Synthetic peptide
  Seed: PGTRVLAMAIYKQSQH (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQH

SEQ ID NO: 28199 - protein, 17 aa, Artificial Sequence
  Description of Artificial Sequence: Synthetic peptide
  Seed: PGTRVLAMAIYKQSQHM (TP53 R158L)
  Core: RVLAMAIYK
  misc_feature (4)..(4): Xaa can be Ala, Cys, Glu, Phe, His, Ile, Lys, Leu, Met, Asn, Pro, Gln, Arg, Ser, Thr, Val, Trp, or Ty r
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
PGTXVLXMXIYXQSQHM

SEQ ID NO: 28200 - protein, 17 aa, Artificial Sequence
  Description of Artificial Sequence: Synthetic peptide
  Seed: PGTRVLAMAIYKQSQHM (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQHM

SEQ ID NO: 28201 - protein, 18 aa, Artificial Sequence
  Description of Artificial Sequence: Synthetic peptide
  Seed: PGTRVLAMAIYKQSQHMT (TP53 R158L)
  Core: RVLAMAIYK
  misc_feature (4)..(4): Xaa can be Phe, Lys, Arg, or Tyr
  misc_feature (7)..(7): Xaa can be Ala, Glu, Phe, Gly, His, Ile, Lys, Leu, Met, Asn, Pro, Gln, Ser, Thr, or Val
  misc_feature (9)..(9): Xaa can be Ala, Gly, Ile, Leu, Met, Asn, Pro, Ser, Thr, or Val
  misc_feature (12)..(12): Xaa can be Ala, Asp, Glu, Phe, Gly, His, Ile, Lys, Leu, Met, Asn, Pro, Gln, Ser, Thr, Val, or Tyr
PGTXVLXMXIYXQSQHMT

SEQ ID NO: 28202 - protein, 18 aa, Artificial Sequence
  Description of Artificial Sequence: Synthetic peptide
  Seed: PGTRVLAMAIYKQSQHMT (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQHMT

SEQ ID NO: 28203 - protein, 19 aa, Artificial Sequence
  Description of Artificial Sequence: Synthetic peptide
  Seed: PGTRVLAMAIYKQSQHMTE (TP53 R158L)
  Core: RVLAMAIYK
  misc_feature (4)..(4): Xaa can be Glu, Phe, His, Ile, Lys, Leu, Met, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Ser, Thr, Val, or Tr p
  misc_feature (9)..(9): Xaa can be Ala, Cys, Asp, Glu, Phe, Gly, His, Ile, Leu, Met, Asn, Pro, Gln, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
PGTXVLXMXIYXQSQHMTE

SEQ ID NO: 28204 - protein, 19 aa, Artificial Sequence
  Description of Artificial Sequence: Synthetic peptide
  Seed: PGTRVLAMAIYKQSQHMTE (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQHMTE

SEQ ID NO: 28205 - protein, 20 aa, Artificial Sequence
  Description of Artificial Sequence: Synthetic peptide
  Seed: PGTRVLAMAIYKQSQHMTEV (TP53 R158L)
  Core: RVLAMAIYK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGTXVLXMXIYXQSQHMTEV

SEQ ID NO: 28206 - protein, 20 aa, Artificial Sequence
  Description of Artificial Sequence: Synthetic peptide
  Seed: PGTRVLAMAIYKQSQHMTEV (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQHMTEV

SEQ ID NO: 28207 - protein, 21 aa, Artificial Sequence
  Description of Artificial Sequence: Synthetic peptide
  Seed: PGTRVLAMAIYKQSQHMTEVV (TP53 R158L)
  Core: RVLAMAIYK
  misc_feature (4)..(4): Xaa can be Glu, Phe, His, Ile, Lys, Leu, Met, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PGTXVLXMXIYXQSQHMTEVV

SEQ ID NO: 28208 - protein, 21 aa, Artificial Sequence
  Description of Artificial Sequence: Synthetic peptide
  Seed: PGTRVLAMAIYKQSQHMTEVV (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQHMTEVV

SEQ ID NO: 28209 - protein, 22 aa, Artificial Sequence
  Description of Artificial Sequence: Synthetic peptide
  Seed: PGTRVLAMAIYKQSQHMTEVVR (TP53 R158L)
  Core: RVLAMAIYK
  misc_feature (4)..(4): Xaa can be Glu, Phe, His, Ile, Lys, Leu, Met, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
PGTXVLXMXIYXQSQHMTEVVR

SEQ ID NO: 28210 - protein, 22 aa, Artificial Sequence
  Description of Artificial Sequence: Synthetic peptide
  Seed: PGTRVLAMAIYKQSQHMTEVVR (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQHMTEVVR

SEQ ID NO: 28211 - protein, 23 aa, Artificial Sequence
  Description of Artificial Sequence: Synthetic peptide
  Seed: PGTRVLAMAIYKQSQHMTEVVRR (TP53 R158L)
  Core: RVLAMAIYK
  misc_feature (4)..(4): Xaa can be Phe, His, Ile, Lys, Leu, Met, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
PGTXVLXMXIYXQSQHMTEVVRR

SEQ ID NO: 28212 - protein, 23 aa, Artificial Sequence
  Description of Artificial Sequence: Synthetic peptide
  Seed: PGTRVLAMAIYKQSQHMTEVVRR (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQHMTEVVRR

SEQ ID NO: 28213 - protein, 24 aa, Artificial Sequence
  Description of Artificial Sequence: Synthetic peptide
  Seed: PGTRVLAMAIYKQSQHMTEVVRRC (TP53 R158L)
  Core: RVLAMAIYK
  misc_feature (4)..(4): Xaa can be Glu, Phe, His, Ile, Lys, Leu, Met, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
PGTXVLXMXIYXQSQHMTEVVRRC

SEQ ID NO: 28214 - protein, 24 aa, Artificial Sequence
  Description of Artificial Sequence: Synthetic peptide
  Seed: PGTRVLAMAIYKQSQHMTEVVRRC (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQHMTEVVRRC

SEQ ID NO: 28215 - protein, 25 aa, Artificial Sequence
  Description of Artificial Sequence: Synthetic peptide
  Seed: PGTRVLAMAIYKQSQHMTEVVRRCP (TP53 R158L)
  Core: RVLAMAIYK
  misc_feature (4)..(4): Xaa can be Phe, His, Ile, Lys, Leu, Met, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
PGTXVLXMXIYXQSQHMTEVVRRCP

SEQ ID NO: 28216 - protein, 25 aa, Artificial Sequence
  Description of Artificial Sequence: Synthetic peptide
  Seed: PGTRVLAMAIYKQSQHMTEVVRRCP (TP53 R158L)
  Core: VLAMAIYKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PGTRXLAXAXYKXSQHMTEVVRRCP

SEQ ID NO: 28217 - protein, 14 aa, Artificial Sequence
  Description of Artificial Sequence: Synthetic peptide
  Seed: PPGTRVLAMAIYKQ (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKX

SEQ ID NO: 28218 - protein, 15 aa, Artificial Sequence
  Description of Artificial Sequence: Synthetic peptide
  Seed: PPGTRVLAMAIYKQS (TP53 R158L)
  Core: GTRVLAMAI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PPXTRXLXMAXYKQS

SEQ ID NO: 28219 - protein, 15 aa, Artificial Sequence
  Description of Artificial Sequence: Synthetic peptide
  Seed: PPGTRVLAMAIYKQS (TP53 R158L)
  Core: RVLAMAIYK
  misc_feature (5)..(5): Xaa can be Phe, or Arg
  misc_feature (8)..(8): Xaa can be Ala, His, Ser, or Thr
  misc_feature (10)..(10): Xaa can be Ala, Pro, or Ser
  misc_feature (13)..(13): Xaa can be Ala, Ile, Lys, Leu, Met, Asn, Arg, or Val
PPGTXVLXMXIYXQS

SEQ ID NO: 28220 - protein, 15 aa, Artificial Sequence
  Description of Artificial Sequence: Synthetic peptide
  Seed: PPGTRVLAMAIYKQS (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXS

SEQ ID NO: 28221 - protein, 16 aa, Artificial Sequence
  Description of Artificial Sequence: Synthetic peptide
  Seed: PPGTRVLAMAIYKQSQ (TP53 R158L)
  Core: RVLAMAIYK
  misc_feature (5)..(5): Xaa can be Ala, Cys, Glu, Phe, His, Ile, Lys, Leu, Met, Asn, Pro, Gln, Arg, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PPGTXVLXMXIYXQSQ

SEQ ID NO: 28222 - protein, 16 aa, Artificial Sequence
  Description of Artificial Sequence: Synthetic peptide
  Seed: PPGTRVLAMAIYKQSQ (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQ

SEQ ID NO: 28223 - protein, 17 aa, Artificial Sequence
  Description of Artificial Sequence: Synthetic peptide
  Seed: PPGTRVLAMAIYKQSQH (TP53 R158L)
  Core: RVLAMAIYK
  misc_feature (5)..(5): Xaa can be Ala, Cys, Glu, Phe, His, Ile, Lys, Leu, Met, Asn, Pro, Gln, Arg, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PPGTXVLXMXIYXQSQH

SEQ ID NO: 28224 - protein, 17 aa, Artificial Sequence
  Description of Artificial Sequence: Synthetic peptide
  Seed: PPGTRVLAMAIYKQSQH (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQH

SEQ ID NO: 28225 - protein, 18 aa, Artificial Sequence
  Description of Artificial Sequence: Synthetic peptide
  Seed: PPGTRVLAMAIYKQSQHM (TP53 R158L)
  Core: RVLAMAIYK
  misc_feature (5)..(5): Xaa can be Phe, His, Ile, Lys, Leu, Met, Gln, Arg, Val, Trp, or Tyr
  misc_feature (8)..(8): Xaa can be Ala, Cys, Asp, Glu, Phe, Gly, His, Ile, Lys, Leu, Met, Asn, Pro, Gln, Ser, Thr, Val, or Tr p
  misc_feature (10)..(10): Xaa can be Ala, Cys, Glu, Phe, Gly, His, Ile, Lys, Leu, Met, Pro, Gln, Arg, Ser, Thr, Val, Trp, or Ty r
  misc_feature (13)..(13): Xaa can be Ala, Asp, Glu, Phe, Gly, His, Ile, Lys, Leu, Met, Asn, Pro, Gln, Arg, Ser, Thr, Val, or Ty r
PPGTXVLXMXIYXQSQHM

SEQ ID NO: 28226 - protein, 18 aa, Artificial Sequence
  Description of Artificial Sequence: Synthetic peptide
  Seed: PPGTRVLAMAIYKQSQHM (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQHM

SEQ ID NO: 28227 - protein, 19 aa, Artificial Sequence
  Description of Artificial Sequence: Synthetic peptide
  Seed: PPGTRVLAMAIYKQSQHMT (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQHMT

SEQ ID NO: 28228 - protein, 20 aa, Artificial Sequence
  Description of Artificial Sequence: Synthetic peptide
  Seed: PPGTRVLAMAIYKQSQHMTE (TP53 R158L)
  Core: RVLAMAIYK
  misc_feature (5)..(5): Xaa can be Glu, Phe, His, Ile, Lys, Leu, Met, Asn, Pro, Gln, Arg, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Asp, Glu, Phe, Gly, His, Ile, Lys, Leu, Met, Asn, Pro, Gln, Arg, Ser, Thr, Val, or Ty r
PPGTXVLXMXIYXQSQHMTE

SEQ ID NO: 28229 - protein, 20 aa, Artificial Sequence
  Description of Artificial Sequence: Synthetic peptide
  Seed: PPGTRVLAMAIYKQSQHMTE (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQHMTE

SEQ ID NO: 28230 - protein, 21 aa, Artificial Sequence
  Description of Artificial Sequence: Synthetic peptide
  Seed: PPGTRVLAMAIYKQSQHMTEV (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQHMTEV

SEQ ID NO: 28231 - protein, 22 aa, Artificial Sequence
  Description of Artificial Sequence: Synthetic peptide
  Seed: PPGTRVLAMAIYKQSQHMTEVV (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQHMTEVV

SEQ ID NO: 28232 - protein, 23 aa, Artificial Sequence
  Description of Artificial Sequence: Synthetic peptide
  Seed: PPGTRVLAMAIYKQSQHMTEVVR (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQHMTEVVR

SEQ ID NO: 28233 - protein, 24 aa, Artificial Sequence
  Description of Artificial Sequence: Synthetic peptide
  Seed: PPGTRVLAMAIYKQSQHMTEVVRR (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQHMTEVVRR

SEQ ID NO: 28234 - protein, 25 aa, Artificial Sequence
  Description of Artificial Sequence: Synthetic peptide
  Seed: PPGTRVLAMAIYKQSQHMTEVVRRC (TP53 R158L)
  Core: VLAMAIYKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPGTRXLAXAXYKXSQHMTEVVRRC

SEQ ID NO: 28235 - protein, 15 aa, Artificial Sequence
  Description of Artificial Sequence: Synthetic peptide
  Seed: PPPGTRVLAMAIYKQ (TP53 R158L)
  Core: GTRVLAMAI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PPPXTRXLXMAXYKQ

SEQ ID NO: 28236 - protein, 15 aa, Artificial Sequence
  Description of Artificial Sequence: Synthetic peptide
  Seed: PPPGTRVLAMAIYKQ (TP53 R158L)
  Core: RVLAMAIYK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTXVLXMXIYXQ

SEQ ID NO: 28237 - protein, 15 aa, Artificial Sequence
  Description of Artificial Sequence: Synthetic peptide
  Seed: PPPGTRVLAMAIYKQ (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKX

SEQ ID NO: 28238 - protein, 16 aa, Artificial Sequence
  Description of Artificial Sequence: Synthetic peptide
  Seed: PPPGTRVLAMAIYKQS (TP53 R158L)
  Core: GTRVLAMAI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PPPXTRXLXMAXYKQS

SEQ ID NO: 28239 - protein, 16 aa, Artificial Sequence
  Description of Artificial Sequence: Synthetic peptide
  Seed: PPPGTRVLAMAIYKQS (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXS

SEQ ID NO: 28240 - protein, 17 aa, Artificial Sequence
  Description of Artificial Sequence: Synthetic peptide
  Seed: PPPGTRVLAMAIYKQSQ (TP53 R158L)
  Core: GTRVLAMAI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PPPXTRXLXMAXYKQSQ

SEQ ID NO: 28241 - protein, 17 aa, Artificial Sequence
  Description of Artificial Sequence: Synthetic peptide
  Seed: PPPGTRVLAMAIYKQSQ (TP53 R158L)
  Core: RVLAMAIYK
  misc_feature (6)..(6): Xaa can be Ala, Cys, Glu, Phe, His, Ile, Lys, Leu, Met, Asn, Pro, Gln, Arg, Ser, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTXVLXMXIYXQSQ

SEQ ID NO: 28242 - protein, 17 aa, Artificial Sequence
  Description of Artificial Sequence: Synthetic peptide
  Seed: PPPGTRVLAMAIYKQSQ (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXSQ

SEQ ID NO: 28243 - protein, 18 aa, Artificial Sequence
  Description of Artificial Sequence: Synthetic peptide
  Seed: PPPGTRVLAMAIYKQSQH (TP53 R158L)
  Core: RVLAMAIYK
  misc_feature (6)..(6): Xaa can be Phe, Ile, Lys, Leu, Arg, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Glu, Phe, Gly, His, Ile, Leu, Met, Asn, Pro, Gln, Arg, Ser, Thr, Val, Trp, or Ty r
  misc_feature (14)..(14): Xaa can be Ala, Asp, Glu, Phe, Gly, His, Ile, Lys, Leu, Met, Asn, Pro, Gln, Arg, Ser, Thr, Val, or Ty r
PPPGTXVLXMXIYXQSQH

SEQ ID NO: 28244 - protein, 18 aa, Artificial Sequence
  Description of Artificial Sequence: Synthetic peptide
  Seed: PPPGTRVLAMAIYKQSQH (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXSQH

SEQ ID NO: 28245 - protein, 19 aa, Artificial Sequence
  Description of Artificial Sequence: Synthetic peptide
  Seed: PPPGTRVLAMAIYKQSQHM (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXSQHM

SEQ ID NO: 28246 - protein, 20 aa, Artificial Sequence
  Description of Artificial Sequence: Synthetic peptide
  Seed: PPPGTRVLAMAIYKQSQHMT (TP53 R158L)
  Core: GTRVLAMAI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PPPXTRXLXMAXYKQSQHMT

SEQ ID NO: 28247 - protein, 20 aa, Artificial Sequence
  Description of Artificial Sequence: Synthetic peptide
  Seed: PPPGTRVLAMAIYKQSQHMT (TP53 R158L)
  Core: RVLAMAIYK
  misc_feature (6)..(6): Xaa can be Ala, Cys, Asp, Glu, Phe, His, Ile, Lys, Leu, Met, Asn, Pro, Gln, Arg, Thr, Val, Trp, or Ty r
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTXVLXMXIYXQSQHMT

SEQ ID NO: 28248 - protein, 20 aa, Artificial Sequence
  Description of Artificial Sequence: Synthetic peptide
  Seed: PPPGTRVLAMAIYKQSQHMT (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXSQHMT

SEQ ID NO: 28249 - protein, 21 aa, Artificial Sequence
  Description of Artificial Sequence: Synthetic peptide
  Seed: PPPGTRVLAMAIYKQSQHMTE (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXSQHMTE

SEQ ID NO: 28250 - protein, 22 aa, Artificial Sequence
  Description of Artificial Sequence: Synthetic peptide
  Seed: PPPGTRVLAMAIYKQSQHMTEV (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXSQHMTEV

SEQ ID NO: 28251 - protein, 23 aa, Artificial Sequence
  Description of Artificial Sequence: Synthetic peptide
  Seed: PPPGTRVLAMAIYKQSQHMTEVV (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXSQHMTEVV

SEQ ID NO: 28252 - protein, 24 aa, Artificial Sequence
  Description of Artificial Sequence: Synthetic peptide
  Seed: PPPGTRVLAMAIYKQSQHMTEVVR (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXSQHMTEVVR

SEQ ID NO: 28253 - protein, 25 aa, Artificial Sequence
  Description of Artificial Sequence: Synthetic peptide
  Seed: PPPGTRVLAMAIYKQSQHMTEVVRR (TP53 R158L)
  Core: VLAMAIYKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PPPGTRXLAXAXYKXSQHMTEVVRR

SEQ ID NO: 28254 - protein, 24 aa, Artificial Sequence
  Description of Artificial Sequence: Synthetic peptide
  Seed: PVQLWVDSTPPPGTRVLAMAIYKQ (TP53 R158L)
  Core: VLAMAIYKQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PVQLWVDSTPPPGTRXLAXAXYKX

SEQ ID NO: 28255 - protein, 25 aa, Artificial Sequence
  Description of Artificial Sequence: Synthetic peptide
  Seed: PVQLWVDSTPPPGTRVLAMAIYKQS (TP53 R158L)
  Core: GTRVLAMAI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Phe, Gly, His, Ile, Leu, Met, Asn, Gln, Ser, Thr, Val, Trp, or Tyr
  misc_feature (18)..(18): Xaa can be Ala, Cys, Asp, Glu, Phe, Gly, His, Ile, Leu, Met, Asn, Pro, Gln, Ser, Thr, Val, Trp, or Ty r
  misc_feature (21)..(21): Xaa can be Ala, Cys, Asp, Glu, Phe, Gly, His, Ile, Leu, Met, Asn, Pro, Gln, Arg, Ser, Thr, Val, Trp, or Tyr
PVQLWVDSTPPPXTRXLXMAXYKQS

SEQ ID NO: 28256 - protein, 25 aa, Artificial Sequence
  Description of Artificial Sequence: Synthetic peptide
  Seed: PVQLWVDSTPPPGTRVLAMAIYKQS (TP53 R158L)
  Core: VLAMAIYKQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
PVQLWVDSTPPPGTRXLAXAXYKXS

SEQ ID NO: 28257 - protein, 22 aa, Artificial Sequence
  Description of Artificial Sequence: Synthetic peptide
  Seed: QLWVDSTPPPGTRVLAMAIYKQ (TP53 R158L)
  Core: VLAMAIYKQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Glu, Phe, Gly, His, Ile, Lys, Leu, Met, Asn, Gln, Arg, Ser, Thr, Val, Trp, or Ty r
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLWVDSTPPPGTRXLAXAXYKX

SEQ ID NO: 28258 - protein, 23 aa, Artificial Sequence
  Description of Artificial Sequence: Synthetic peptide
  Seed: QLWVDSTPPPGTRVLAMAIYKQS (TP53 R158L)
  Core: VLAMAIYKQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLWVDSTPPPGTRXLAXAXYKXS

SEQ ID NO: 28259 - protein, 24 aa, Artificial Sequence
  Description of Artificial Sequence: Synthetic peptide
  Seed: QLWVDSTPPPGTRVLAMAIYKQSQ (TP53 R158L)
  Core: RVLAMAIYK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QLWVDSTPPPGTXVLXMXIYXQSQ

SEQ ID NO: 28260 - protein, 24 aa, Artificial Sequence
  Description of Artificial Sequence: Synthetic peptide
  Seed: QLWVDSTPPPGTRVLAMAIYKQSQ (TP53 R158L)
  Core: VLAMAIYKQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLWVDSTPPPGTRXLAXAXYKXSQ

SEQ ID NO: 28261 - protein, 25 aa, Artificial Sequence
  Description of Artificial Sequence: Synthetic peptide
  Seed: QLWVDSTPPPGTRVLAMAIYKQSQH (TP53 R158L)
  Core: RVLAMAIYK
  misc_feature (13)..(13): Xaa can be Ala, Cys, Glu, Phe, His, Ile, Lys, Leu, Met, Gln, Arg, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, or Tyr
QLWVDSTPPPGTXVLXMXIYXQSQH

SEQ ID NO: 28262 - protein, 25 aa, Artificial Sequence
  Description of Artificial Sequence: Synthetic peptide
  Seed: QLWVDSTPPPGTRVLAMAIYKQSQH (TP53 R158L)
  Core: VLAMAIYKQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLWVDSTPPPGTRXLAXAXYKXSQH

SEQ ID NO: 28263 - protein, 13 aa, Artificial Sequence
  Description of Artificial Sequence: Synthetic peptide
  Seed: RVLAMAIYKQSQH (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQH

SEQ ID NO: 28264 - protein, 14 aa, Artificial Sequence
  Description of Artificial Sequence: Synthetic peptide
  Seed: RVLAMAIYKQSQHM (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHM

SEQ ID NO: 28265 - protein, 15 aa, Artificial Sequence
  Description of Artificial Sequence: Synthetic peptide
  Seed: RVLAMAIYKQSQHMT (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMT

SEQ ID NO: 28266 - protein, 16 aa, Artificial Sequence
  Description of Artificial Sequence: Synthetic peptide
  Seed: RVLAMAIYKQSQHMTE (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMTE

SEQ ID NO: 28267 - protein, 17 aa, Artificial Sequence
  Description of Artificial Sequence: Synthetic peptide
  Seed: RVLAMAIYKQSQHMTEV (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Ser, Thr, Val, Trp, or Tyr
  misc_feature (5)..(5): Xaa can be Ala, Cys, Asp, Glu, Phe, Gly, His, Ile, Leu, Met, Asn, Gln, Ser, Thr, Val, Trp, or Tyr
  misc_feature (7)..(7): Xaa can be Ala, Cys, Asp, Glu, Phe, Gly, His, Ile, Leu, Met, Asn, Pro, Gln, Ser, Thr, or Val
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMTEV

SEQ ID NO: 28268 - protein, 19 aa, Artificial Sequence
  Description of Artificial Sequence: Synthetic peptide
  Seed: RVLAMAIYKQSQHMTEVVR (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Ser, Thr, Val, Trp, or Ty r
  misc_feature (7)..(7): Xaa can be Ala, Cys, Asp, Glu, Gly, His, Ile, Lys, Leu, Met, Asn, Pro, Gln, Arg, Ser, Thr, or Val
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMTEVVR

SEQ ID NO: 28269 - protein, 20 aa, Artificial Sequence
  Description of Artificial Sequence: Synthetic peptide
  Seed: RVLAMAIYKQSQHMTEVVRR (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMTEVVRR

SEQ ID NO: 28270 - protein, 21 aa, Artificial Sequence
  Description of Artificial Sequence: Synthetic peptide
  Seed: RVLAMAIYKQSQHMTEVVRRC (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMTEVVRRC

SEQ ID NO: 28271 - protein, 22 aa, Artificial Sequence
  Description of Artificial Sequence: Synthetic peptide
  Seed: RVLAMAIYKQSQHMTEVVRRCP (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMTEVVRRCP

SEQ ID NO: 28272 - protein, 23 aa, Artificial Sequence
  Description of Artificial Sequence: Synthetic peptide
  Seed: RVLAMAIYKQSQHMTEVVRRCPH (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMTEVVRRCPH

SEQ ID NO: 28273 - protein, 24 aa, Artificial Sequence
  Description of Artificial Sequence: Synthetic peptide
  Seed: RVLAMAIYKQSQHMTEVVRRCPHH (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMTEVVRRCPHH

SEQ ID NO: 28274 - protein, 25 aa, Artificial Sequence
  Description of Artificial Sequence: Synthetic peptide
  Seed: RVLAMAIYKQSQHMTEVVRRCPHHE (TP53 R158L)
  Core: VLAMAIYKQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXLAXAXYKXSQHMTEVVRRCPHHE

SEQ ID NO: 28275 - protein, 15 aa, Artificial Sequence
  Description of Artificial Sequence: Synthetic peptide
  Seed: STPPPGTRVLAMAIY (TP53 R158L)
  Core: PPGTRVLAM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
STPXPGXRXLAXAIY

SEQ ID NO: 28276 - protein, 15 aa, Artificial Sequence
  Description of Artificial Sequence: Synthetic peptide
  Seed: STPPPGTRVLAMAIY (TP53 R158L)
  Core: GTRVLAMAI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STPPPXTRXLXMAXY

SEQ ID NO: 28277 - protein, 16 aa, Artificial Sequence
  Description of Artificial Sequence: Synthetic peptide
  Seed: STPPPGTRVLAMAIYK (TP53 R158L)
  Core: PPGTRVLAM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
STPXPGXRXLAXAIYK

SEQ ID NO: 28278 - protein, 16 aa, Artificial Sequence
  Description of Artificial Sequence: Synthetic peptide
  Seed: STPPPGTRVLAMAIYK (TP53 R158L)
  Core: GTRVLAMAI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STPPPXTRXLXMAXYK

SEQ ID NO: 28279 - protein, 17 aa, Artificial Sequence
  Description of Artificial Sequence: Synthetic peptide
  Seed: STPPPGTRVLAMAIYKQ (TP53 R158L)
  Core: PPGTRVLAM
  misc_feature (4)..(4): Xaa can be Ala, Cys, Asp, Glu, Phe, Gly, His, Ile, Lys, Leu, Met, Asn, Pro, Gln, Ser, Thr, Val, Trp, or Tyr
  misc_feature (7)..(7): Xaa can be Ala, Cys, Asp, Phe, Gly, Ile, Leu, Met, Asn, Gln, Ser, Thr, Val, or Trp
  misc_feature (9)..(9): Xaa can be Ala, Cys, Asp, Glu, Phe, His, Ile, Leu, Met, Asn, Pro, Gln, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
STPXPGXRXLAXAIYKQ

SEQ ID NO: 28280 - protein, 17 aa, Artificial Sequence
  Description of Artificial Sequence: Synthetic peptide
  Seed: STPPPGTRVLAMAIYKQ (TP53 R158L)
  Core: GTRVLAMAI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STPPPXTRXLXMAXYKQ

SEQ ID NO: 28281 - protein, 17 aa, Artificial Sequence
  Description of Artificial Sequence: Synthetic peptide
  Seed: STPPPGTRVLAMAIYKQ (TP53 R158L)
  Core: VLAMAIYKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTRXLAXAXYKX

SEQ ID NO: 28282 - protein, 18 aa, Artificial Sequence
  Description of Artificial Sequence: Synthetic peptide
  Seed: STPPPGTRVLAMAIYKQS (TP53 R158L)
  Core: GTRVLAMAI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STPPPXTRXLXMAXYKQS

SEQ ID NO: 28283 - protein, 18 aa, Artificial Sequence
  Description of Artificial Sequence: Synthetic peptide
  Seed: STPPPGTRVLAMAIYKQS (TP53 R158L)
  Core: VLAMAIYKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTRXLAXAXYKXS

SEQ ID NO: 28284 - protein, 19 aa, Artificial Sequence
  Description of Artificial Sequence: Synthetic peptide
  Seed: STPPPGTRVLAMAIYKQSQ (TP53 R158L)
  Core: VLAMAIYKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTRXLAXAXYKXSQ

SEQ ID NO: 28285 - protein, 20 aa, Artificial Sequence
  Description of Artificial Sequence: Synthetic peptide
  Seed: STPPPGTRVLAMAIYKQSQH (TP53 R158L)
  Core: GTRVLAMAI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STPPPXTRXLXMAXYKQSQH

SEQ ID NO: 28286 - protein, 20 aa, Artificial Sequence
  Description of Artificial Sequence: Synthetic peptide
  Seed: STPPPGTRVLAMAIYKQSQH (TP53 R158L)
  Core: RVLAMAIYK
  misc_feature (8)..(8): Xaa can be Ala, Cys, Glu, Phe, His, Ile, Lys, Leu, Met, Asn, Pro, Gln, Arg, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTXVLXMXIYXQSQH

SEQ ID NO: 28287 - protein, 20 aa, Artificial Sequence
  Description of Artificial Sequence: Synthetic peptide
  Seed: STPPPGTRVLAMAIYKQSQH (TP53 R158L)
  Core: VLAMAIYKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTRXLAXAXYKXSQH

SEQ ID NO: 28288 - protein, 21 aa, Artificial Sequence
  Description of Artificial Sequence: Synthetic peptide
  Seed: STPPPGTRVLAMAIYKQSQHM (TP53 R158L)
  Core: VLAMAIYKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTRXLAXAXYKXSQHM

SEQ ID NO: 28289 - protein, 22 aa, Artificial Sequence
  Description of Artificial Sequence: Synthetic peptide
  Seed: STPPPGTRVLAMAIYKQSQHMT (TP53 R158L)
  Core: VLAMAIYKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTRXLAXAXYKXSQHMT

SEQ ID NO: 28290 - protein, 23 aa, Artificial Sequence
  Description of Artificial Sequence: Synthetic peptide
  Seed: STPPPGTRVLAMAIYKQSQHMTE (TP53 R158L)
  Core: VLAMAIYKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTRXLAXAXYKXSQHMTE

SEQ ID NO: 28291 - protein, 24 aa, Artificial Sequence
  Description of Artificial Sequence: Synthetic peptide
  Seed: STPPPGTRVLAMAIYKQSQHMTEV (TP53 R158L)
  Core: VLAMAIYKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTRXLAXAXYKXSQHMTEV

SEQ ID NO: 28292 - protein, 25 aa, Artificial Sequence
  Description of Artificial Sequence: Synthetic peptide
  Seed: STPPPGTRVLAMAIYKQSQHMTEVV (TP53 R158L)
  Core: GTRVLAMAI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
STPPPXTRXLXMAXYKQSQHMTEVV

SEQ ID NO: 28293 - protein, 25 aa, Artificial Sequence
  Description of Artificial Sequence: Synthetic peptide
  Seed: STPPPGTRVLAMAIYKQSQHMTEVV (TP53 R158L)
  Core: VLAMAIYKQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STPPPGTRXLAXAXYKXSQHMTEVV

SEQ ID NO: 28294 - protein, 15 aa, Artificial Sequence
  Description of Artificial Sequence: Synthetic peptide
  Seed: TPPPGTRVLAMAIYK (TP53 R158L)
  Core: PPGTRVLAM
  misc_feature (3)..(3): Xaa can be Ala, Cys, Asp, Glu, Phe, His, Ile, Leu, Met, Asn, Pro, Gln, Ser, Thr, Val, Trp, or Tyr
  misc_feature (6)..(6): Xaa can be Ala, Cys, Glu, Phe, Gly, Ile, Leu, Met, Asn, Gln, Ser, Thr, Val, or Trp
  misc_feature (8)..(8): Xaa can be Ala, Cys, Ile, Leu, Met, Asn, Pro, Ser, Thr, Val, or Trp
  misc_feature (11)..(11): Xaa can be Ala, Cys, Asp, Glu, Phe, Gly, His, Ile, Leu, Met, Asn, Pro, Gln, Arg, Ser, Thr, Val, Trp, or Tyr
TPXPGXRXLAXAIYK

SEQ ID NO: 28295 - protein, 15 aa, Artificial Sequence
  Description of Artificial Sequence: Synthetic peptide
  Seed: TPPPGTRVLAMAIYK (TP53 R158L)
  Core: GTRVLAMAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPPPXTRXLXMAXYK

SEQ ID NO: 28296 - protein, 16 aa, Artificial Sequence
  Description of Artificial Sequence: Synthetic peptide
  Seed: TPPPGTRVLAMAIYKQ (TP53 R158L)
  Core: GTRVLAMAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPPPXTRXLXMAXYKQ

SEQ ID NO: 28297 - protein, 16 aa, Artificial Sequence
  Description of Artificial Sequence: Synthetic peptide
  Seed: TPPPGTRVLAMAIYKQ (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKX

SEQ ID NO: 28298 - protein, 17 aa, Artificial Sequence
  Description of Artificial Sequence: Synthetic peptide
  Seed: TPPPGTRVLAMAIYKQS (TP53 R158L)
  Core: GTRVLAMAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPPPXTRXLXMAXYKQS

SEQ ID NO: 28299 - protein, 17 aa, Artificial Sequence
  Description of Artificial Sequence: Synthetic peptide
  Seed: TPPPGTRVLAMAIYKQS (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKXS

SEQ ID NO: 28300 - protein, 18 aa, Artificial Sequence
  Description of Artificial Sequence: Synthetic peptide
  Seed: TPPPGTRVLAMAIYKQSQ (TP53 R158L)
  Core: RVLAMAIYK
  misc_feature (7)..(7): Xaa can be Phe, Ile, Lys, Leu, Met, Arg, Val, Trp, or Tyr
  misc_feature (10)..(10): Xaa can be Ala, Cys, Asp, Glu, Phe, Gly, His, Ile, Lys, Leu, Met, Asn, Gln, Arg, Ser, Thr, Val, Trp, or Tyr
  misc_feature (12)..(12): Xaa can be Ala, Glu, Phe, Gly, His, Ile, Leu, Met, Asn, Pro, Gln, Ser, Thr, Val, Trp, or Tyr
  misc_feature (15)..(15): Xaa can be Ala, Asp, Glu, Phe, His, Ile, Lys, Leu, Met, Asn, Pro, Gln, Arg, Ser, Thr, Val, or Tyr
TPPPGTXVLXMXIYXQSQ

SEQ ID NO: 28301 - protein, 18 aa, Artificial Sequence
  Description of Artificial Sequence: Synthetic peptide
  Seed: TPPPGTRVLAMAIYKQSQ (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKXSQ

SEQ ID NO: 28302 - protein, 19 aa, Artificial Sequence
  Description of Artificial Sequence: Synthetic peptide
  Seed: TPPPGTRVLAMAIYKQSQH (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKXSQH

SEQ ID NO: 28303 - protein, 20 aa, Artificial Sequence
  Description of Artificial Sequence: Synthetic peptide
  Seed: TPPPGTRVLAMAIYKQSQHM (TP53 R158L)
  Core: GTRVLAMAI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPPPXTRXLXMAXYKQSQHM

SEQ ID NO: 28304 - protein, 20 aa, Artificial Sequence
  Description of Artificial Sequence: Synthetic peptide
  Seed: TPPPGTRVLAMAIYKQSQHM (TP53 R158L)
  Core: RVLAMAIYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTXVLXMXIYXQSQHM

SEQ ID NO: 28305 - protein, 20 aa, Artificial Sequence
  Description of Artificial Sequence: Synthetic peptide
  Seed: TPPPGTRVLAMAIYKQSQHM (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKXSQHM

SEQ ID NO: 28306 - protein, 21 aa, Artificial Sequence
  Description of Artificial Sequence: Synthetic peptide
  Seed: TPPPGTRVLAMAIYKQSQHMT (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKXSQHMT

SEQ ID NO: 28307 - protein, 22 aa, Artificial Sequence
  Description of Artificial Sequence: Synthetic peptide
  Seed: TPPPGTRVLAMAIYKQSQHMTE (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKXSQHMTE

SEQ ID NO: 28308 - protein, 23 aa, Artificial Sequence
  Description of Artificial Sequence: Synthetic peptide
  Seed: TPPPGTRVLAMAIYKQSQHMTEV (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKXSQHMTEV

SEQ ID NO: 28309 - protein, 24 aa, Artificial Sequence
  Description of Artificial Sequence: Synthetic peptide
  Seed: TPPPGTRVLAMAIYKQSQHMTEVV (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKXSQHMTEVV

SEQ ID NO: 28310 - protein, 25 aa, Artificial Sequence
  Description of Artificial Sequence: Synthetic peptide
  Seed: TPPPGTRVLAMAIYKQSQHMTEVVR (TP53 R158L)
  Core: VLAMAIYKQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPPPGTRXLAXAXYKXSQHMTEVVR

SEQ ID NO: 28311 - protein, 13 aa, Artificial Sequence
  Description of Artificial Sequence: Synthetic peptide
  Seed: TRVLAMAIYKQSQ (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQ

SEQ ID NO: 28312 - protein, 14 aa, Artificial Sequence
  Description of Artificial Sequence: Synthetic peptide
  Seed: TRVLAMAIYKQSQH (TP53 R158L)
  Core: RVLAMAIYK
  misc_feature (2)..(2): Xaa can be Phe, Ile, Lys, Leu, Met, Arg, or Tyr
  misc_feature (5)..(5): Xaa can be Ala, Cys, Asp, Glu, Phe, Gly, His, Ile, Lys, Leu, Met, Asn, Pro, Gln, Ser, Thr, Val, or Tr p
  misc_feature (7)..(7): Xaa can be Ala, Phe, Gly, Ile, Leu, Met, Asn, Pro, Ser, Thr, or Val
  misc_feature (10)..(10): Xaa can be Ala, Cys, Asp, Glu, Phe, Gly, His, Ile, Lys, Leu, Met, Asn, Pro, Gln, Arg, Ser, Thr, Val, or Tyr
TXVLXMXIYXQSQH

SEQ ID NO: 28313 - protein, 14 aa, Artificial Sequence
  Description of Artificial Sequence: Synthetic peptide
  Seed: TRVLAMAIYKQSQH (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQH

SEQ ID NO: 28314 - protein, 15 aa, Artificial Sequence
  Description of Artificial Sequence: Synthetic peptide
  Seed: TRVLAMAIYKQSQHM (TP53 R158L)
  Core: RVLAMAIYK
  misc_feature (2)..(2): Xaa can be Phe, His, Ile, Lys, Leu, Met, Gln, Arg, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, or Tyr
TXVLXMXIYXQSQHM

SEQ ID NO: 28315 - protein, 15 aa, Artificial Sequence
  Description of Artificial Sequence: Synthetic peptide
  Seed: TRVLAMAIYKQSQHM (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHM

SEQ ID NO: 28316 - protein, 16 aa, Artificial Sequence
  Description of Artificial Sequence: Synthetic peptide
  Seed: TRVLAMAIYKQSQHMT (TP53 R158L)
  Core: RVLAMAIYK
  misc_feature (2)..(2): Xaa can be Phe, His, Ile, Lys, Leu, Met, Gln, Arg, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Glu, Phe, Gly, Ile, Leu, Met, Asn, Pro, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, or Tyr
TXVLXMXIYXQSQHMT

SEQ ID NO: 28317 - protein, 16 aa, Artificial Sequence
  Description of Artificial Sequence: Synthetic peptide
  Seed: TRVLAMAIYKQSQHMT (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMT

SEQ ID NO: 28318 - protein, 17 aa, Artificial Sequence
  Description of Artificial Sequence: Synthetic peptide
  Seed: TRVLAMAIYKQSQHMTE (TP53 R158L)
  Core: RVLAMAIYK
  misc_feature (2)..(2): Xaa can be Phe, Lys, or Arg
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Phe, Gly, Ile, Leu, Met, Pro, Ser, Thr, Val, or Trp
  misc_feature (10)..(10): Xaa can be Ala, Asp, Glu, Phe, Gly, His, Ile, Lys, Leu, Met, Asn, Pro, Gln, Arg, Ser, Thr, Val, or Ty r
TXVLXMXIYXQSQHMTE

SEQ ID NO: 28319 - protein, 17 aa, Artificial Sequence
  Description of Artificial Sequence: Synthetic peptide
  Seed: TRVLAMAIYKQSQHMTE (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMTE

SEQ ID NO: 28320 - protein, 18 aa, Artificial Sequence
  Description of Artificial Sequence: Synthetic peptide
  Seed: TRVLAMAIYKQSQHMTEV (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMTEV

SEQ ID NO: 28321 - protein, 19 aa, Artificial Sequence
  Description of Artificial Sequence: Synthetic peptide
  Seed: TRVLAMAIYKQSQHMTEVV (TP53 R158L)
  Core: RVLAMAIYK
  misc_feature (2)..(2): Xaa can be , or Arg
  misc_feature (5)..(5): Xaa can be Ala, Glu, His, Ile, Lys, Leu, Met, Asn, Gln, Ser, Thr, or Val
  misc_feature (7)..(7): Xaa can be Ala, Ile, Pro, Ser, Thr, or Val
  misc_feature (10)..(10): Xaa can be Ala, Asp, Glu, Gly, His, Ile, Lys, Leu, Met, Asn, Gln, Ser, Thr, or Val
TXVLXMXIYXQSQHMTEVV

SEQ ID NO: 28322 - protein, 19 aa, Artificial Sequence
  Description of Artificial Sequence: Synthetic peptide
  Seed: TRVLAMAIYKQSQHMTEVV (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMTEVV

SEQ ID NO: 28323 - protein, 20 aa, Artificial Sequence
  Description of Artificial Sequence: Synthetic peptide
  Seed: TRVLAMAIYKQSQHMTEVVR (TP53 R158L)
  Core: RVLAMAIYK
  misc_feature (2)..(2): Xaa can be Phe, Lys, or Arg
  misc_feature (5)..(5): Xaa can be Ala, Cys, Asp, Glu, Phe, Gly, His, Ile, Lys, Leu, Met, Asn, Pro, Gln, Ser, Thr, Val, or Tr p
  misc_feature (7)..(7): Xaa can be Ala, Gly, Ile, Leu, Met, Asn, Pro, Ser, Thr, or Val
  misc_feature (10)..(10): Xaa can be Ala, Asp, Glu, Gly, His, Ile, Lys, Leu, Met, Asn, Gln, Ser, Thr, or Val
TXVLXMXIYXQSQHMTEVVR

SEQ ID NO: 28324 - protein, 20 aa, Artificial Sequence
  Description of Artificial Sequence: Synthetic peptide
  Seed: TRVLAMAIYKQSQHMTEVVR (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMTEVVR

SEQ ID NO: 28325 - protein, 21 aa, Artificial Sequence
  Description of Artificial Sequence: Synthetic peptide
  Seed: TRVLAMAIYKQSQHMTEVVRR (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMTEVVRR

SEQ ID NO: 28326 - protein, 22 aa, Artificial Sequence
  Description of Artificial Sequence: Synthetic peptide
  Seed: TRVLAMAIYKQSQHMTEVVRRC (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMTEVVRRC

SEQ ID NO: 28327 - protein, 23 aa, Artificial Sequence
  Description of Artificial Sequence: Synthetic peptide
  Seed: TRVLAMAIYKQSQHMTEVVRRCP (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMTEVVRRCP

SEQ ID NO: 28328 - protein, 24 aa, Artificial Sequence
  Description of Artificial Sequence: Synthetic peptide
  Seed: TRVLAMAIYKQSQHMTEVVRRCPH (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMTEVVRRCPH

SEQ ID NO: 28329 - protein, 25 aa, Artificial Sequence
  Description of Artificial Sequence: Synthetic peptide
  Seed: TRVLAMAIYKQSQHMTEVVRRCPHH (TP53 R158L)
  Core: VLAMAIYKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TRXLAXAXYKXSQHMTEVVRRCPHH

SEQ ID NO: 28330 - protein, 15 aa, Artificial Sequence
  Description of Artificial Sequence: Synthetic peptide
  Seed: VDSTPPPGTRVLAMA (TP53 R158L)
  Core: PPGTRVLAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Phe, Gly, His, Ile, Leu, Met, Asn, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPXPGXRXLAXA

SEQ ID NO: 28331 - protein, 16 aa, Artificial Sequence
  Description of Artificial Sequence: Synthetic peptide
  Seed: VDSTPPPGTRVLAMAI (TP53 R158L)
  Core: PPGTRVLAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPXPGXRXLAXAI

SEQ ID NO: 28332 - protein, 17 aa, Artificial Sequence
  Description of Artificial Sequence: Synthetic peptide
  Seed: VDSTPPPGTRVLAMAIY (TP53 R158L)
  Core: PPGTRVLAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPXPGXRXLAXAIY

SEQ ID NO: 28333 - protein, 19 aa, Artificial Sequence
  Description of Artificial Sequence: Synthetic peptide
  Seed: VDSTPPPGTRVLAMAIYKQ (TP53 R158L)
  Core: PPGTRVLAM
  misc_feature (6)..(6): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Asp, Phe, Gly, His, Ile, Leu, Met, Asn, Pro, Gln, Ser, Thr, Val, or Trp
  misc_feature (11)..(11): Xaa can be Ala, Cys, Asp, Glu, Phe, His, Ile, Leu, Met, Asn, Pro, Gln, Ser, Thr, Val, or Trp
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPXPGXRXLAXAIYKQ

SEQ ID NO: 28334 - protein, 19 aa, Artificial Sequence
  Description of Artificial Sequence: Synthetic peptide
  Seed: VDSTPPPGTRVLAMAIYKQ (TP53 R158L)
  Core: GTRVLAMAI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPXTRXLXMAXYKQ

SEQ ID NO: 28335 - protein, 19 aa, Artificial Sequence
  Description of Artificial Sequence: Synthetic peptide
  Seed: VDSTPPPGTRVLAMAIYKQ (TP53 R158L)
  Core: VLAMAIYKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPGTRXLAXAXYKX

SEQ ID NO: 28336 - protein, 20 aa, Artificial Sequence
  Description of Artificial Sequence: Synthetic peptide
  Seed: VDSTPPPGTRVLAMAIYKQS (TP53 R158L)
  Core: PPGTRVLAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Phe, Gly, His, Ile, Leu, Met, Asn, Pro, Gln, Ser, Thr, Val, or Trp
  misc_feature (11)..(11): Xaa can be Ala, Cys, Asp, Glu, Phe, Gly, His, Ile, Leu, Met, Asn, Pro, Gln, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPXPGXRXLAXAIYKQS

SEQ ID NO: 28337 - protein, 20 aa, Artificial Sequence
  Description of Artificial Sequence: Synthetic peptide
  Seed: VDSTPPPGTRVLAMAIYKQS (TP53 R158L)
  Core: GTRVLAMAI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPXTRXLXMAXYKQS

SEQ ID NO: 28338 - protein, 20 aa, Artificial Sequence
  Description of Artificial Sequence: Synthetic peptide
  Seed: VDSTPPPGTRVLAMAIYKQS (TP53 R158L)
  Core: RVLAMAIYK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPGTXVLXMXIYXQS

SEQ ID NO: 28339 - protein, 20 aa, Artificial Sequence
  Description of Artificial Sequence: Synthetic peptide
  Seed: VDSTPPPGTRVLAMAIYKQS (TP53 R158L)
  Core: VLAMAIYKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPGTRXLAXAXYKXS

SEQ ID NO: 28340 - protein, 21 aa, Artificial Sequence
  Description of Artificial Sequence: Synthetic peptide
  Seed: VDSTPPPGTRVLAMAIYKQSQ (TP53 R158L)
  Core: RVLAMAIYK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPGTXVLXMXIYXQSQ

SEQ ID NO: 28341 - protein, 21 aa, Artificial Sequence
  Description of Artificial Sequence: Synthetic peptide
  Seed: VDSTPPPGTRVLAMAIYKQSQ (TP53 R158L)
  Core: VLAMAIYKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPGTRXLAXAXYKXSQ

SEQ ID NO: 28342 - protein, 22 aa, Artificial Sequence
  Description of Artificial Sequence: Synthetic peptide
  Seed: VDSTPPPGTRVLAMAIYKQSQH (TP53 R158L)
  Core: VLAMAIYKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPGTRXLAXAXYKXSQH

SEQ ID NO: 28343 - protein, 23 aa, Artificial Sequence
  Description of Artificial Sequence: Synthetic peptide
  Seed: VDSTPPPGTRVLAMAIYKQSQHM (TP53 R158L)
  Core: RVLAMAIYK
  misc_feature (10)..(10): Xaa can be Cys, Glu, Phe, His, Ile, Lys, Leu, Met, Pro, Gln, Arg, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, or Tyr
VDSTPPPGTXVLXMXIYXQSQHM

SEQ ID NO: 28344 - protein, 23 aa, Artificial Sequence
  Description of Artificial Sequence: Synthetic peptide
  Seed: VDSTPPPGTRVLAMAIYKQSQHM (TP53 R158L)
  Core: VLAMAIYKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPGTRXLAXAXYKXSQHM

SEQ ID NO: 28345 - protein, 24 aa, Artificial Sequence
  Description of Artificial Sequence: Synthetic peptide
  Seed: VDSTPPPGTRVLAMAIYKQSQHMT (TP53 R158L)
  Core: RVLAMAIYK
  misc_feature (10)..(10): Xaa can be Cys, Asp, Glu, Phe, His, Ile, Lys, Leu, Met, Gln, Arg, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, or Tyr
VDSTPPPGTXVLXMXIYXQSQHMT

SEQ ID NO: 28346 - protein, 24 aa, Artificial Sequence
  Description of Artificial Sequence: Synthetic peptide
  Seed: VDSTPPPGTRVLAMAIYKQSQHMT (TP53 R158L)
  Core: VLAMAIYKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPGTRXLAXAXYKXSQHMT

SEQ ID NO: 28347 - protein, 25 aa, Artificial Sequence
  Description of Artificial Sequence: Synthetic peptide
  Seed: VDSTPPPGTRVLAMAIYKQSQHMTE (TP53 R158L)
  Core: RVLAMAIYK
  misc_feature (10)..(10): Xaa can be Cys, Glu, Phe, His, Ile, Lys, Leu, Met, Gln, Arg, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, or Tyr
VDSTPPPGTXVLXMXIYXQSQHMTE

SEQ ID NO: 28348 - protein, 25 aa, Artificial Sequence
  Description of Artificial Sequence: Synthetic peptide
  Seed: VDSTPPPGTRVLAMAIYKQSQHMTE (TP53 R158L)
  Core: VLAMAIYKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VDSTPPPGTRXLAXAXYKXSQHMTE

SEQ ID NO: 28349 - protein, 23 aa, Artificial Sequence
  Description of Artificial Sequence: Synthetic peptide
  Seed: VQLWVDSTPPPGTRVLAMAIYKQ (TP53 R158L)
  Core: VLAMAIYKQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VQLWVDSTPPPGTRXLAXAXYKX

SEQ ID NO: 28350 - protein, 24 aa, Artificial Sequence
  Description of Artificial Sequence: Synthetic peptide
  Seed: VQLWVDSTPPPGTRVLAMAIYKQS (TP53 R158L)
  Core: VLAMAIYKQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VQLWVDSTPPPGTRXLAXAXYKXS

SEQ ID NO: 28351 - protein, 25 aa, Artificial Sequence
  Description of Artificial Sequence: Synthetic peptide
  Seed: VQLWVDSTPPPGTRVLAMAIYKQSQ (TP53 R158L)
  Core: RVLAMAIYK
  misc_feature (14)..(14): Xaa can be Ala, Cys, Glu, Phe, His, Ile, Lys, Leu, Met, Asn, Pro, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, or Tyr
VQLWVDSTPPPGTXVLXMXIYXQSQ

SEQ ID NO: 28352 - protein, 25 aa, Artificial Sequence
  Description of Artificial Sequence: Synthetic peptide
  Seed: VQLWVDSTPPPGTRVLAMAIYKQSQ (TP53 R158L)
  Core: VLAMAIYKQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VQLWVDSTPPPGTRXLAXAXYKXSQ

SEQ ID NO: 28353 - protein, 15 aa, Artificial Sequence
  Description of Artificial Sequence: Synthetic peptide
  Seed: WVDSTPPPGTRVLAM (TP53 R158L)
  Core: PPGTRVLAM
  misc_feature (7)..(7): Xaa can be Ala, Cys, Asp, Glu, Phe, Gly, His, Ile, Lys, Leu, Met, Asn, Pro, Gln, Ser, Thr, Val, Trp, or Tyr
  misc_feature (10)..(10): Xaa can be Ala, Cys, Glu, Phe, Gly, Ile, Leu, Met, Asn, Gln, Ser, Thr, Val, or Trp
  misc_feature (12)..(12): Xaa can be Ala, Cys, Asp, Glu, Phe, Gly, Ile, Leu, Met, Asn, Pro, Gln, Ser, Thr, Val, or Trp
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPXPGXRXLAX

SEQ ID NO: 28354 - protein, 16 aa, Artificial Sequence
  Description of Artificial Sequence: Synthetic peptide
  Seed: WVDSTPPPGTRVLAMA (TP53 R158L)
  Core: PPGTRVLAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Glu, Phe, Gly, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPXPGXRXLAXA

SEQ ID NO: 28355 - protein, 17 aa, Artificial Sequence
  Description of Artificial Sequence: Synthetic peptide
  Seed: WVDSTPPPGTRVLAMAI (TP53 R158L)
  Core: PPGTRVLAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPXPGXRXLAXAI

SEQ ID NO: 28356 - protein, 19 aa, Artificial Sequence
  Description of Artificial Sequence: Synthetic peptide
  Seed: WVDSTPPPGTRVLAMAIYK (TP53 R158L)
  Core: PPGTRVLAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Leu, Met, Asn, Pro, Gln, Ser, Thr, Val, Trp, or Ty r
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPXPGXRXLAXAIYK

SEQ ID NO: 28357 - protein, 19 aa, Artificial Sequence
  Description of Artificial Sequence: Synthetic peptide
  Seed: WVDSTPPPGTRVLAMAIYK (TP53 R158L)
  Core: GTRVLAMAI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPXTRXLXMAXYK

SEQ ID NO: 28358 - protein, 20 aa, Artificial Sequence
  Description of Artificial Sequence: Synthetic peptide
  Seed: WVDSTPPPGTRVLAMAIYKQ (TP53 R158L)
  Core: PPGTRVLAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPXPGXRXLAXAIYKQ

SEQ ID NO: 28359 - protein, 20 aa, Artificial Sequence
  Description of Artificial Sequence: Synthetic peptide
  Seed: WVDSTPPPGTRVLAMAIYKQ (TP53 R158L)
  Core: GTRVLAMAI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPXTRXLXMAXYKQ

SEQ ID NO: 28360 - protein, 20 aa, Artificial Sequence
  Description of Artificial Sequence: Synthetic peptide
  Seed: WVDSTPPPGTRVLAMAIYKQ (TP53 R158L)
  Core: RVLAMAIYK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Glu, Gly, His, Ile, Lys, Leu, Met, Asn, Pro, Gln, Arg, Ser, Thr, Val, Trp, or Ty r
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPGTXVLXMXIYXQ

SEQ ID NO: 28361 - protein, 20 aa, Artificial Sequence
  Description of Artificial Sequence: Synthetic peptide
  Seed: WVDSTPPPGTRVLAMAIYKQ (TP53 R158L)
  Core: VLAMAIYKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPGTRXLAXAXYKX

SEQ ID NO: 28362 - protein, 21 aa, Artificial Sequence
  Description of Artificial Sequence: Synthetic peptide
  Seed: WVDSTPPPGTRVLAMAIYKQS (TP53 R158L)
  Core: RVLAMAIYK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Gly, His, Ile, Lys, Leu, Met, Asn, Pro, Gln, Arg, Ser, Thr, Val, or Ty r
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPGTXVLXMXIYXQS

SEQ ID NO: 28363 - protein, 21 aa, Artificial Sequence
  Description of Artificial Sequence: Synthetic peptide
  Seed: WVDSTPPPGTRVLAMAIYKQS (TP53 R158L)
  Core: VLAMAIYKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPGTRXLAXAXYKXS

SEQ ID NO: 28364 - protein, 22 aa, Artificial Sequence
  Description of Artificial Sequence: Synthetic peptide
  Seed: WVDSTPPPGTRVLAMAIYKQSQ (TP53 R158L)
  Core: PPGTRVLAM
  misc_feature (7)..(7): Xaa can be Ala, Cys, Asp, Glu, Phe, Gly, His, Ile, Lys, Leu, Met, Asn, Pro, Gln, Ser, Thr, Val, Trp, or Tyr
  misc_feature (10)..(10): Xaa can be Ala, Cys, Gly, Ile, Met, Asn, Ser, Thr, or Val
  misc_feature (12)..(12): Xaa can be Ala, Cys, Asp, Glu, Gly, Ile, Leu, Met, Asn, Pro, Gln, Ser, Thr, or Val
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPXPGXRXLAXAIYKQSQ

SEQ ID NO: 28365 - protein, 22 aa, Artificial Sequence
  Description of Artificial Sequence: Synthetic peptide
  Seed: WVDSTPPPGTRVLAMAIYKQSQ (TP53 R158L)
  Core: RVLAMAIYK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPGTXVLXMXIYXQSQ

SEQ ID NO: 28366 - protein, 22 aa, Artificial Sequence
  Description of Artificial Sequence: Synthetic peptide
  Seed: WVDSTPPPGTRVLAMAIYKQSQ (TP53 R158L)
  Core: VLAMAIYKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPGTRXLAXAXYKXSQ

SEQ ID NO: 28367 - protein, 23 aa, Artificial Sequence
  Description of Artificial Sequence: Synthetic peptide
  Seed: WVDSTPPPGTRVLAMAIYKQSQH (TP53 R158L)
  Core: RVLAMAIYK
  misc_feature (11)..(11): Xaa can be Cys, Glu, Phe, His, Ile, Lys, Leu, Met, Gln, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, or Tyr
WVDSTPPPGTXVLXMXIYXQSQH

SEQ ID NO: 28368 - protein, 23 aa, Artificial Sequence
  Description of Artificial Sequence: Synthetic peptide
  Seed: WVDSTPPPGTRVLAMAIYKQSQH (TP53 R158L)
  Core: VLAMAIYKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPGTRXLAXAXYKXSQH

SEQ ID NO: 28369 - protein, 24 aa, Artificial Sequence
  Description of Artificial Sequence: Synthetic peptide
  Seed: WVDSTPPPGTRVLAMAIYKQSQHM (TP53 R158L)
  Core: RVLAMAIYK
  misc_feature (11)..(11): Xaa can be Cys, Glu, Phe, His, Ile, Lys, Leu, Met, Pro, Gln, Arg, Ser, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, or Tyr
WVDSTPPPGTXVLXMXIYXQSQHM

SEQ ID NO: 28370 - protein, 24 aa, Artificial Sequence
  Description of Artificial Sequence: Synthetic peptide
  Seed: WVDSTPPPGTRVLAMAIYKQSQHM (TP53 R158L)
  Core: VLAMAIYKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPGTRXLAXAXYKXSQHM

SEQ ID NO: 28371 - protein, 25 aa, Artificial Sequence
  Description of Artificial Sequence: Synthetic peptide
  Seed: WVDSTPPPGTRVLAMAIYKQSQHMT (TP53 R158L)
  Core: RVLAMAIYK
  misc_feature (11)..(11): Xaa can be Cys, Asp, Glu, Phe, His, Ile, Lys, Leu, Met, Gln, Arg, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, or Tyr
WVDSTPPPGTXVLXMXIYXQSQHMT

SEQ ID NO: 28372 - protein, 25 aa, Artificial Sequence
  Description of Artificial Sequence: Synthetic peptide
  Seed: WVDSTPPPGTRVLAMAIYKQSQHMT (TP53 R158L)
  Core: VLAMAIYKQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WVDSTPPPGTRXLAXAXYKXSQHMT

SEQ ID NO: 28373 - protein, 20 aa, Artificial Sequence
  Description of Artificial Sequence: Synthetic peptide
  Seed: AIYKQSQHMTEVVRHCPHHE (TP53 R175H)
  Core: HMTEVVRHC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQXMTXVXRHXPHHE

SEQ ID NO: 28374 - protein, 20 aa, Artificial Sequence
  Description of Artificial Sequence: Synthetic peptide
  Seed: AIYKQSQHMTEVVRHCPHHE (TP53 R175H)
  Core: MTEVVRHCP
  misc_feature (9)..(9): Xaa can be Ala, Cys, Phe, His, Ile, Lys, Leu, Met, Asn, Pro, Gln, Arg, Ser, Thr, Val, Trp, or Tyr
  misc_feature (12)..(12): Xaa can be Ala, Cys, Phe, His, Ile, Lys, Leu, Met, Asn, Gln, Arg, Ser, Thr, Val, Trp, or Tyr
  misc_feature (14)..(14): Xaa can be Ala, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHXTEXVXHCXHHE

SEQ ID NO: 28375 - protein, 24 aa, Artificial Sequence
  Description of Artificial Sequence: Synthetic peptide
  Seed: AIYKQSQHMTEVVRHCPHHERCSD (TP53 R175H)
  Core: VRHCPHHER
  misc_feature (13)..(13): Xaa can be Ala, Cys, Phe, His, Ile, Leu, Met, Gln, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEVXRHXPXHEXCSD

SEQ ID NO: 28376 - protein, 25 aa, Artificial Sequence
  Description of Artificial Sequence: Synthetic peptide
  Seed: AIYKQSQHMTEVVRHCPHHERCSDS (TP53 R175H)
  Core: VRHCPHHER
  misc_feature (13)..(13): Xaa can be Ala, Cys, Phe, His, Ile, Leu, Met, Gln, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AIYKQSQHMTEVXRHXPXHEXCSDS

SEQ ID NO: 28377 - protein, 21 aa, Artificial Sequence
  Description of Artificial Sequence: Synthetic peptide
  Seed: AMAIYKQSQHMTEVVRHCPHH (TP53 R175H)
  Core: HMTEVVRHC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQXMTXVXRHXPHH

SEQ ID NO: 28378 - protein, 22 aa, Artificial Sequence
  Description of Artificial Sequence: Synthetic peptide
  Seed: AMAIYKQSQHMTEVVRHCPHHE (TP53 R175H)
  Core: HMTEVVRHC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQXMTXVXRHXPHHE

SEQ ID NO: 28379 - protein, 22 aa, Artificial Sequence
  Description of Artificial Sequence: Synthetic peptide
  Seed: AMAIYKQSQHMTEVVRHCPHHE (TP53 R175H)
  Core: MTEVVRHCP
  misc_feature (11)..(11): Xaa can be Ala, Cys, Phe, His, Ile, Leu, Met, Pro, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHXTEXVXHCXHHE

SEQ ID NO: 28380 - protein, 23 aa, Artificial Sequence
  Description of Artificial Sequence: Synthetic peptide
  Seed: AMAIYKQSQHMTEVVRHCPHHER (TP53 R175H)
  Core: HMTEVVRHC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQXMTXVXRHXPHHER

SEQ ID NO: 28381 - protein, 23 aa, Artificial Sequence
  Description of Artificial Sequence: Synthetic peptide
  Seed: AMAIYKQSQHMTEVVRHCPHHER (TP53 R175H)
  Core: MTEVVRHCP
  misc_feature (11)..(11): Xaa can be Cys, Phe, Ile, Leu, Met, Val, Trp, or Tyr
  misc_feature (14)..(14): Xaa can be Ala, Cys, Phe, Gly, His, Ile, Lys, Leu, Met, Asn, Gln, Arg, Ser, Thr, Val, Trp, or Tyr
  misc_feature (16)..(16): Xaa can be Ala, Glu, Phe, Gly, His, Ile, Lys, Leu, Met, Asn, Pro, Gln, Arg, Ser, Thr, Val, Trp, or Ty r
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHXTEXVXHCXHHER

SEQ ID NO: 28382 - protein, 24 aa, Artificial Sequence
  Description of Artificial Sequence: Synthetic peptide
  Seed: AMAIYKQSQHMTEVVRHCPHHERC (TP53 R175H)
  Core: HMTEVVRHC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQXMTXVXRHXPHHERC

SEQ ID NO: 28383 - protein, 24 aa, Artificial Sequence
  Description of Artificial Sequence: Synthetic peptide
  Seed: AMAIYKQSQHMTEVVRHCPHHERC (TP53 R175H)
  Core: MTEVVRHCP
  misc_feature (11)..(11): Xaa can be Cys, Phe, Ile, Lys, Leu, Met, Asn, Gln, Val, Trp, or Tyr
  misc_feature (14)..(14): Xaa can be Ala, Cys, Glu, Phe, Gly, His, Ile, Lys, Leu, Met, Asn, Gln, Arg, Ser, Thr, Val, Trp, or Ty r
  misc_feature (16)..(16): Xaa can be Ala, Glu, Phe, Gly, His, Ile, Lys, Leu, Met, Asn, Pro, Gln, Arg, Ser, Thr, Val, Trp, or Ty r
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHXTEXVXHCXHHERC

SEQ ID NO: 28384 - protein, 25 aa, Artificial Sequence
  Description of Artificial Sequence: Synthetic peptide
  Seed: AMAIYKQSQHMTEVVRHCPHHERCS (TP53 R175H)
  Core: MTEVVRHCP
  misc_feature (11)..(11): Xaa can be Phe, Ile, Leu, Met, Arg, Val, Trp, or Tyr
  misc_feature (14)..(14): Xaa can be Ala, Cys, Phe, His, Ile, Lys, Leu, Met, Gln, Arg, Ser, Thr, Val, Trp, or Tyr
  misc_feature (16)..(16): Xaa can be Ala, Gly, His, Ile, Lys, Leu, Met, Asn, Gln, Arg, Ser, Thr, or Val
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHXTEXVXHCXHHERCS

SEQ ID NO: 28385 - protein, 25 aa, Artificial Sequence
  Description of Artificial Sequence: Synthetic peptide
  Seed: AMAIYKQSQHMTEVVRHCPHHERCS (TP53 R175H)
  Core: VRHCPHHER
  misc_feature (15)..(15): Xaa can be Ala, Cys, Phe, Ile, Leu, Met, Thr, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AMAIYKQSQHMTEVXRHXPXHEXCS

SEQ ID NO: 28386 - protein, 15 aa, Artificial Sequence
  Description of Artificial Sequence: Synthetic peptide
  Seed: HMTEVVRHCPHHERC (TP53 R175H)
  Core: VRHCPHHER
  misc_feature (6)..(6): Xaa can be Ala, Cys, Phe, Gly, His, Ile, Leu, Met, Asn, Gln, Ser, Thr, Val, Trp, or Tyr
  misc_feature (9)..(9): Xaa can be Ala, Cys, Glu, Phe, Gly, His, Ile, Lys, Leu, Met, Asn, Gln, Arg, Ser, Thr, Val, Trp, or Ty r
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HMTEVXRHXPXHEXC

SEQ ID NO: 28387 - protein, 20 aa, Artificial Sequence
  Description of Artificial Sequence: Synthetic peptide
  Seed: IYKQSQHMTEVVRHCPHHER (TP53 R175H)
  Core: HMTEVVRHC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQXMTXVXRHXPHHER

SEQ ID NO: 28388 - protein, 23 aa, Artificial Sequence
  Description of Artificial Sequence: Synthetic peptide
  Seed: IYKQSQHMTEVVRHCPHHERCSD (TP53 R175H)
  Core: VRHCPHHER
  misc_feature (12)..(12): Xaa can be Ala, Cys, Phe, His, Ile, Leu, Met, Gln, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEVXRHXPXHEXCSD

SEQ ID NO: 28389 - protein, 24 aa, Artificial Sequence
  Description of Artificial Sequence: Synthetic peptide
  Seed: IYKQSQHMTEVVRHCPHHERCSDS (TP53 R175H)
  Core: VRHCPHHER
  misc_feature (12)..(12): Xaa can be Ala, Cys, Phe, His, Ile, Leu, Met, Gln, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEVXRHXPXHEXCSDS

SEQ ID NO: 28390 - protein, 25 aa, Artificial Sequence
  Description of Artificial Sequence: Synthetic peptide
  Seed: IYKQSQHMTEVVRHCPHHERCSDSD (TP53 R175H)
  Core: VRHCPHHER
  misc_feature (12)..(12): Xaa can be Ala, Cys, Phe, His, Ile, Leu, Met, Gln, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IYKQSQHMTEVXRHXPXHEXCSDSD

SEQ ID NO: 28391 - protein, 20 aa, Artificial Sequence
  Description of Artificial Sequence: Synthetic peptide
  Seed: MAIYKQSQHMTEVVRHCPHH (TP53 R175H)
  Core: HMTEVVRHC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQXMTXVXRHXPHH

SEQ ID NO: 28392 - protein, 20 aa, Artificial Sequence
  Description of Artificial Sequence: Synthetic peptide
  Seed: MAIYKQSQHMTEVVRHCPHH (TP53 R175H)
  Core: MTEVVRHCP
  misc_feature (10)..(10): Xaa can be Ala, Cys, Phe, Ile, Leu, Met, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHXTEXVXHCXHH

SEQ ID NO: 28393 - protein, 21 aa, Artificial Sequence
  Description of Artificial Sequence: Synthetic peptide
  Seed: MAIYKQSQHMTEVVRHCPHHE (TP53 R175H)
  Core: HMTEVVRHC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQXMTXVXRHXPHHE

SEQ ID NO: 28394 - protein, 21 aa, Artificial Sequence
  Description of Artificial Sequence: Synthetic peptide
  Seed: MAIYKQSQHMTEVVRHCPHHE (TP53 R175H)
  Core: MTEVVRHCP
  misc_feature (10)..(10): Xaa can be Ala, Cys, Phe, His, Ile, Lys, Leu, Met, Pro, Gln, Arg, Ser, Thr, Val, Trp, or Tyr
  misc_feature (13)..(13): Xaa can be Ala, Cys, Glu, Phe, His, Ile, Lys, Leu, Met, Asn, Gln, Arg, Ser, Thr, Val, Trp, or Tyr
  misc_feature (15)..(15): Xaa can be Ala, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHXTEXVXHCXHHE

SEQ ID NO: 28395 - protein, 22 aa, Artificial Sequence
  Description of Artificial Sequence: Synthetic peptide
  Seed: MAIYKQSQHMTEVVRHCPHHER (TP53 R175H)
  Core: HMTEVVRHC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQXMTXVXRHXPHHER

SEQ ID NO: 28396 - protein, 23 aa, Artificial Sequence
  Description of Artificial Sequence: Synthetic peptide
  Seed: MAIYKQSQHMTEVVRHCPHHERC (TP53 R175H)
  Core: HMTEVVRHC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQXMTXVXRHXPHHERC

SEQ ID NO: 28397 - protein, 24 aa, Artificial Sequence
  Description of Artificial Sequence: Synthetic peptide
  Seed: MAIYKQSQHMTEVVRHCPHHERCS (TP53 R175H)
  Core: HMTEVVRHC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQXMTXVXRHXPHHERCS

SEQ ID NO: 28398 - protein, 25 aa, Artificial Sequence
  Description of Artificial Sequence: Synthetic peptide
  Seed: MAIYKQSQHMTEVVRHCPHHERCSD (TP53 R175H)
  Core: HMTEVVRHC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQXMTXVXRHXPHHERCSD

SEQ ID NO: 28399 - protein, 25 aa, Artificial Sequence
  Description of Artificial Sequence: Synthetic peptide
  Seed: MAIYKQSQHMTEVVRHCPHHERCSD (TP53 R175H)
  Core: VRHCPHHER
  misc_feature (14)..(14): Xaa can be Ala, Cys, Phe, Gly, His, Ile, Leu, Met, Gln, Thr, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
MAIYKQSQHMTEVXRHXPXHEXCSD

SEQ ID NO: 28400 - protein, 22 aa, Artificial Sequence
  Description of Artificial Sequence: Synthetic peptide
  Seed: RAMAIYKQSQHMTEVVRHCPHH (TP53 R175H)
  Core: HMTEVVRHC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RAMAIYKQSQXMTXVXRHXPHH

SEQ ID NO: 28401 - protein, 22 aa, Artificial Sequence
  Description of Artificial Sequence: Synthetic peptide
  Seed: RAMAIYKQSQHMTEVVRHCPHH (TP53 R175H)
  Core: MTEVVRHCP
  misc_feature (12)..(12): Xaa can be Phe, Ile, Leu, Met, Val, Trp, or Tyr
  misc_feature (15)..(15): Xaa can be Ala, Cys, Phe, His, Ile, Lys, Leu, Met, Gln, Arg, Ser, Thr, Val, Trp, or Tyr
  misc_feature (17)..(17): Xaa can be Ala, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RAMAIYKQSQHXTEXVXHCXHH

SEQ ID NO: 28402 - protein, 23 aa, Artificial Sequence
  Description of Artificial Sequence: Synthetic peptide
  Seed: RAMAIYKQSQHMTEVVRHCPHHE (TP53 R175H)
  Core: MTEVVRHCP
  misc_feature (12)..(12): Xaa can be Ala, Cys, Phe, His, Ile, Leu, Met, Asn, Gln, Val, Trp, or Tyr
  misc_feature (15)..(15): Xaa can be Ala, Cys, Glu, Phe, Gly, His, Ile, Lys, Leu, Met, Asn, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RAMAIYKQSQHXTEXVXHCXHHE

SEQ ID NO: 28403 - protein, 24 aa, Artificial Sequence
  Description of Artificial Sequence: Synthetic peptide
  Seed: RAMAIYKQSQHMTEVVRHCPHHER (TP53 R175H)
  Core: MTEVVRHCP
  misc_feature (12)..(12): Xaa can be Ala, Cys, Phe, Ile, Leu, Met, Gln, Val, Trp, or Tyr
  misc_feature (15)..(15): Xaa can be Ala, Cys, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RAMAIYKQSQHXTEXVXHCXHHER

SEQ ID NO: 28404 - protein, 24 aa, Artificial Sequence
  Description of Artificial Sequence: Synthetic peptide
  Seed: RAMAIYKQSQHMTEVVRHCPHHER (TP53 R175H)
  Core: VRHCPHHER
  misc_feature (16)..(16): Xaa can be Phe, Ile, Leu, Met, Val, Trp, or Tyr
  misc_feature (19)..(19): Xaa can be Ala, Cys, Asp, Glu, Phe, His, Ile, Lys, Leu, Met, Asn, Gln, Arg, Ser, Thr, Val, Trp, or Ty r
  misc_feature (21)..(21): Xaa can be Ala, Cys, Asp, Glu, Phe, Gly, His, Ile, Lys, Leu, Met, Asn, Pro, Gln, Arg, Ser, Thr, or Va l
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RAMAIYKQSQHMTEVXRHXPXHEX

SEQ ID NO: 28405 - protein, 25 aa, Artificial Sequence
  Description of Artificial Sequence: Synthetic peptide
  Seed: RAMAIYKQSQHMTEVVRHCPHHERC (TP53 R175H)
  Core: MTEVVRHCP
  misc_feature (12)..(12): Xaa can be Ala, Cys, Phe, Ile, Leu, Met, Gln, Thr, Val, Trp, or Tyr
  misc_feature (15)..(15): Xaa can be Ala, Cys, Glu, Phe, Gly, His, Ile, Lys, Leu, Met, Asn, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RAMAIYKQSQHXTEXVXHCXHHERC

SEQ ID NO: 28406 - protein, 25 aa, Artificial Sequence
  Description of Artificial Sequence: Synthetic peptide
  Seed: RAMAIYKQSQHMTEVVRHCPHHERC (TP53 R175H)
  Core: VRHCPHHER
  misc_feature (16)..(16): Xaa can be Phe, Ile, Leu, Met, Val, Trp, or Tyr
  misc_feature (19)..(19): Xaa can be Ala, Cys, Asp, Glu, Phe, Gly, His, Ile, Lys, Leu, Met, Asn, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RAMAIYKQSQHMTEVXRHXPXHEXC

SEQ ID NO: 28407 - protein, 25 aa, Artificial Sequence
  Description of Artificial Sequence: Synthetic peptide
  Seed: RVRAMAIYKQSQHMTEVVRHCPHHE (TP53 R175H)
  Core: MTEVVRHCP
  misc_feature (14)..(14): Xaa can be Cys, Phe, Ile, Leu, Met, Pro, Thr, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RVRAMAIYKQSQHXTEXVXHCXHHE

SEQ ID NO: 28408 - protein, 15 aa, Artificial Sequence
  Description of Artificial Sequence: Synthetic peptide
  Seed: SQHMTEVVRHCPHHE (TP53 R175H)
  Core: MTEVVRHCP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Glu, Phe, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQHXTEXVXHCXHHE

SEQ ID NO: 28409 - protein, 24 aa, Artificial Sequence
  Description of Artificial Sequence: Synthetic peptide
  Seed: VRAMAIYKQSQHMTEVVRHCPHHE (TP53 R175H)
  Core: MTEVVRHCP
  misc_feature (13)..(13): Xaa can be Ala, Cys, Phe, Ile, Leu, Met, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VRAMAIYKQSQHXTEXVXHCXHHE

SEQ ID NO: 28410 - protein, 25 aa, Artificial Sequence
  Description of Artificial Sequence: Synthetic peptide
  Seed: VRAMAIYKQSQHMTEVVRHCPHHER (TP53 R175H)
  Core: MTEVVRHCP
  misc_feature (13)..(13): Xaa can be Ala, Cys, Phe, Ile, Leu, Met, Gln, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VRAMAIYKQSQHXTEXVXHCXHHER

SEQ ID NO: 28411 - protein, 15 aa, Artificial Sequence
  Description of Artificial Sequence: Synthetic peptide
  Seed: CMGGMNQRPILTIIT (TP53 R248Q)
  Core: MNQRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNQXPXLTXIT

SEQ ID NO: 28412 - protein, 16 aa, Artificial Sequence
  Description of Artificial Sequence: Synthetic peptide
  Seed: CMGGMNQRPILTIITL (TP53 R248Q)
  Core: MNQRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNQXPXLTXITL

SEQ ID NO: 28413 - protein, 17 aa, Artificial Sequence
  Description of Artificial Sequence: Synthetic peptide
  Seed: CMGGMNQRPILTIITLE (TP53 R248Q)
  Core: MNQRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNQXPXLTXITLE

SEQ ID NO: 28414 - protein, 19 aa, Artificial Sequence
  Description of Artificial Sequence: Synthetic peptide
  Seed: CMGGMNQRPILTIITLEDS (TP53 R248Q)
  Core: MNQRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNQXPXLTXITLEDS

SEQ ID NO: 28415 - protein, 20 aa, Artificial Sequence
  Description of Artificial Sequence: Synthetic peptide
  Seed: CMGGMNQRPILTIITLEDSS (TP53 R248Q)
  Core: MNQRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNQXPXLTXITLEDSS

SEQ ID NO: 28416 - protein, 20 aa, Artificial Sequence
  Description of Artificial Sequence: Synthetic peptide
  Seed: CNSSCMGGMNQRPILTIITL (TP53 R248Q)
  Core: MNQRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNQXPXLTXITL

SEQ ID NO: 28417 - protein, 22 aa, Artificial Sequence
  Description of Artificial Sequence: Synthetic peptide
  Seed: CNSSCMGGMNQRPILTIITLED (TP53 R248Q)
  Core: MNQRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNQXPXLTXITLED

SEQ ID NO: 28418 - protein, 23 aa, Artificial Sequence
  Description of Artificial Sequence: Synthetic peptide
  Seed: CNSSCMGGMNQRPILTIITLEDS (TP53 R248Q)
  Core: MNQRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNQXPXLTXITLEDS

SEQ ID NO: 28419 - protein, 24 aa, Artificial Sequence
  Description of Artificial Sequence: Synthetic peptide
  Seed: CNSSCMGGMNQRPILTIITLEDSS (TP53 R248Q)
  Core: MNQRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNQXPXLTXITLEDSS

SEQ ID NO: 28420 - protein, 25 aa, Artificial Sequence
  Description of Artificial Sequence: Synthetic peptide
  Seed: CNSSCMGGMNQRPILTIITLEDSSG (TP53 R248Q)
  Core: MNQRPILTI
  misc_feature (9)..(9): Xaa can be Ala, Cys, Glu, Phe, His, Ile, Lys, Leu, Met, Pro, Gln, Arg, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Leu, Met, Asn, Pro, Gln, Arg, Ser, Thr, Val, Trp, or Tyr
CNSSCMGGXNQXPXLTXITLEDSSG

SEQ ID NO: 28421 - protein, 25 aa, Artificial Sequence
  Description of Artificial Sequence: Synthetic peptide
  Seed: CTTIHYNYMCNSSCMGGMNQRPILT (TP53 R248Q)
  Core: CMGGMNQRP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
CTTIHYNYMCNSSXMGXMXQRXILT

SEQ ID NO: 28422 - protein, 15 aa, Artificial Sequence
  Description of Artificial Sequence: Synthetic peptide
  Seed: GGMNQRPILTIITLE (TP53 R248Q)
  Core: MNQRPILTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXNQXPXLTXITLE

SEQ ID NO: 28423 - protein, 16 aa, Artificial Sequence
  Description of Artificial Sequence: Synthetic peptide
  Seed: GGMNQRPILTIITLED (TP53 R248Q)
  Core: MNQRPILTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXNQXPXLTXITLED

SEQ ID NO: 28424 - protein, 17 aa, Artificial Sequence
  Description of Artificial Sequence: Synthetic peptide
  Seed: GGMNQRPILTIITLEDS (TP53 R248Q)
  Core: MNQRPILTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXNQXPXLTXITLEDS

SEQ ID NO: 28425 - protein, 24 aa, Artificial Sequence
  Description of Artificial Sequence: Synthetic peptide
  Seed: HYNYMCNSSCMGGMNQRPILTIIT (TP53 R248Q)
  Core: MNQRPILTI
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HYNYMCNSSCMGGXNQXPXLTXIT

SEQ ID NO: 28426 - protein, 25 aa, Artificial Sequence
  Description of Artificial Sequence: Synthetic peptide
  Seed: HYNYMCNSSCMGGMNQRPILTIITL (TP53 R248Q)
  Core: MNQRPILTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HYNYMCNSSCMGGXNQXPXLTXITL

SEQ ID NO: 28427 - protein, 24 aa, Artificial Sequence
  Description of Artificial Sequence: Synthetic peptide
  Seed: IHYNYMCNSSCMGGMNQRPILTII (TP53 R248Q)
  Core: MNQRPILTI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IHYNYMCNSSCMGGXNQXPXLTXI

SEQ ID NO: 28428 - protein, 25 aa, Artificial Sequence
  Description of Artificial Sequence: Synthetic peptide
  Seed: IHYNYMCNSSCMGGMNQRPILTIIT (TP53 R248Q)
  Core: CMGGMNQRP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IHYNYMCNSSXMGXMXQRXILTIIT

SEQ ID NO: 28429 - protein, 25 aa, Artificial Sequence
  Description of Artificial Sequence: Synthetic peptide
  Seed: IHYNYMCNSSCMGGMNQRPILTIIT (TP53 R248Q)
  Core: MNQRPILTI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IHYNYMCNSSCMGGXNQXPXLTXIT

SEQ ID NO: 28430 - protein, 20 aa, Artificial Sequence
  Description of Artificial Sequence: Synthetic peptide
  Seed: MCNSSCMGGMNQRPILTIIT (TP53 R248Q)
  Core: MNQRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNQXPXLTXIT

SEQ ID NO: 28431 - protein, 23 aa, Artificial Sequence
  Description of Artificial Sequence: Synthetic peptide
  Seed: MCNSSCMGGMNQRPILTIITLED (TP53 R248Q)
  Core: MNQRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNQXPXLTXITLED

SEQ ID NO: 28432 - protein, 24 aa, Artificial Sequence
  Description of Artificial Sequence: Synthetic peptide
  Seed: MCNSSCMGGMNQRPILTIITLEDS (TP53 R248Q)
  Core: MNQRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNQXPXLTXITLEDS

SEQ ID NO: 28433 - protein, 25 aa, Artificial Sequence
  Description of Artificial Sequence: Synthetic peptide
  Seed: MCNSSCMGGMNQRPILTIITLEDSS (TP53 R248Q)
  Core: MNQRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNQXPXLTXITLEDSS

SEQ ID NO: 28434 - protein, 15 aa, Artificial Sequence
  Description of Artificial Sequence: Synthetic peptide
  Seed: MGGMNQRPILTIITL (TP53 R248Q)
  Core: MNQRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNQXPXLTXITL

SEQ ID NO: 28435 - protein, 17 aa, Artificial Sequence
  Description of Artificial Sequence: Synthetic peptide
  Seed: MGGMNQRPILTIITLED (TP53 R248Q)
  Core: MNQRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNQXPXLTXITLED

SEQ ID NO: 28436 - protein, 18 aa, Artificial Sequence
  Description of Artificial Sequence: Synthetic peptide
  Seed: MGGMNQRPILTIITLEDS (TP53 R248Q)
  Core: MNQRPILTI
  misc_feature (4)..(4): Xaa can be Ala, Cys, Asp, Glu, Phe, His, Ile, Lys, Leu, Met, Pro, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNQXPXLTXITLEDS

SEQ ID NO: 28437 - protein, 19 aa, Artificial Sequence
  Description of Artificial Sequence: Synthetic peptide
  Seed: MGGMNQRPILTIITLEDSS (TP53 R248Q)
  Core: MNQRPILTI
  misc_feature (4)..(4): Xaa can be Ala, Cys, Glu, Phe, His, Ile, Lys, Leu, Met, Gln, Arg, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Leu, Met, Asn, Pro, Gln, Arg, Ser, Thr, Val, Trp, or Tyr
MGGXNQXPXLTXITLEDSS

SEQ ID NO: 28438 - protein, 20 aa, Artificial Sequence
  Description of Artificial Sequence: Synthetic peptide
  Seed: NSSCMGGMNQRPILTIITLE (TP53 R248Q)
  Core: MNQRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNQXPXLTXITLE

SEQ ID NO: 28439 - protein, 21 aa, Artificial Sequence
  Description of Artificial Sequence: Synthetic peptide
  Seed: NSSCMGGMNQRPILTIITLED (TP53 R248Q)
  Core: MNQRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNQXPXLTXITLED

SEQ ID NO: 28440 - protein, 22 aa, Artificial Sequence
  Description of Artificial Sequence: Synthetic peptide
  Seed: NSSCMGGMNQRPILTIITLEDS (TP53 R248Q)
  Core: MNQRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNQXPXLTXITLEDS

SEQ ID NO: 28441 - protein, 23 aa, Artificial Sequence
  Description of Artificial Sequence: Synthetic peptide
  Seed: NSSCMGGMNQRPILTIITLEDSS (TP53 R248Q)
  Core: MNQRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNQXPXLTXITLEDSS

SEQ ID NO: 28442 - protein, 24 aa, Artificial Sequence
  Description of Artificial Sequence: Synthetic peptide
  Seed: NSSCMGGMNQRPILTIITLEDSSG (TP53 R248Q)
  Core: MNQRPILTI
  misc_feature (8)..(8): Xaa can be Ala, Cys, Glu, Phe, His, Ile, Lys, Leu, Met, Pro, Gln, Arg, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Leu, Met, Asn, Pro, Gln, Arg, Ser, Thr, Val, Trp, or Tyr
NSSCMGGXNQXPXLTXITLEDSSG

SEQ ID NO: 28443 - protein, 20 aa, Artificial Sequence
  Description of Artificial Sequence: Synthetic peptide
  Seed: NYMCNSSCMGGMNQRPILTI (TP53 R248Q)
  Core: CMGGMNQRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSXMGXMXQRXILTI

SEQ ID NO: 28444 - protein, 23 aa, Artificial Sequence
  Description of Artificial Sequence: Synthetic peptide
  Seed: NYMCNSSCMGGMNQRPILTIITL (TP53 R248Q)
  Core: MNQRPILTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSCMGGXNQXPXLTXITL

SEQ ID NO: 28445 - protein, 24 aa, Artificial Sequence
  Description of Artificial Sequence: Synthetic peptide
  Seed: NYMCNSSCMGGMNQRPILTIITLE (TP53 R248Q)
  Core: MNQRPILTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSCMGGXNQXPXLTXITLE

SEQ ID NO: 28446 - protein, 25 aa, Artificial Sequence
  Description of Artificial Sequence: Synthetic peptide
  Seed: NYMCNSSCMGGMNQRPILTIITLED (TP53 R248Q)
  Core: MNQRPILTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSCMGGXNQXPXLTXITLED

SEQ ID NO: 28447 - protein, 15 aa, Artificial Sequence
  Description of Artificial Sequence: Synthetic peptide
  Seed: SCMGGMNQRPILTII (TP53 R248Q)
  Core: MNQRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNQXPXLTXI

SEQ ID NO: 28448 - protein, 17 aa, Artificial Sequence
  Description of Artificial Sequence: Synthetic peptide
  Seed: SCMGGMNQRPILTIITL (TP53 R248Q)
  Core: MNQRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNQXPXLTXITL

SEQ ID NO: 28449 - protein, 19 aa, Artificial Sequence
  Description of Artificial Sequence: Synthetic peptide
  Seed: SCMGGMNQRPILTIITLED (TP53 R248Q)
  Core: MNQRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNQXPXLTXITLED

SEQ ID NO: 28450 - protein, 20 aa, Artificial Sequence
  Description of Artificial Sequence: Synthetic peptide
  Seed: SCMGGMNQRPILTIITLEDS (TP53 R248Q)
  Core: MNQRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNQXPXLTXITLEDS

SEQ ID NO: 28451 - protein, 21 aa, Artificial Sequence
  Description of Artificial Sequence: Synthetic peptide
  Seed: SCMGGMNQRPILTIITLEDSS (TP53 R248Q)
  Core: MNQRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNQXPXLTXITLEDSS

SEQ ID NO: 28452 - protein, 19 aa, Artificial Sequence
  Description of Artificial Sequence: Synthetic peptide
  Seed: SSCMGGMNQRPILTIITLE (TP53 R248Q)
  Core: MNQRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNQXPXLTXITLE

SEQ ID NO: 28453 - protein, 20 aa, Artificial Sequence
  Description of Artificial Sequence: Synthetic peptide
  Seed: SSCMGGMNQRPILTIITLED (TP53 R248Q)
  Core: MNQRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNQXPXLTXITLED

SEQ ID NO: 28454 - protein, 21 aa, Artificial Sequence
  Description of Artificial Sequence: Synthetic peptide
  Seed: SSCMGGMNQRPILTIITLEDS (TP53 R248Q)
  Core: MNQRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNQXPXLTXITLEDS

SEQ ID NO: 28455 - protein, 22 aa, Artificial Sequence
  Description of Artificial Sequence: Synthetic peptide
  Seed: SSCMGGMNQRPILTIITLEDSS (TP53 R248Q)
  Core: MNQRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNQXPXLTXITLEDSS

SEQ ID NO: 28456 - protein, 24 aa, Artificial Sequence
  Description of Artificial Sequence: Synthetic peptide
  Seed: TIHYNYMCNSSCMGGMNQRPILTI (TP53 R248Q)
  Core: CMGGMNQRP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TIHYNYMCNSSXMGXMXQRXILTI

SEQ ID NO: 28457 - protein, 25 aa, Artificial Sequence
  Description of Artificial Sequence: Synthetic peptide
  Seed: TIHYNYMCNSSCMGGMNQRPILTII (TP53 R248Q)
  Core: CMGGMNQRP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TIHYNYMCNSSXMGXMXQRXILTII

SEQ ID NO: 28458 - protein, 24 aa, Artificial Sequence
  Description of Artificial Sequence: Synthetic peptide
  Seed: TTIHYNYMCNSSCMGGMNQRPILT (TP53 R248Q)
  Core: CMGGMNQRP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TTIHYNYMCNSSXMGXMXQRXILT

SEQ ID NO: 28459 - protein, 25 aa, Artificial Sequence
  Description of Artificial Sequence: Synthetic peptide
  Seed: TTIHYNYMCNSSCMGGMNQRPILTI (TP53 R248Q)
  Core: CMGGMNQRP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TTIHYNYMCNSSXMGXMXQRXILTI

SEQ ID NO: 28460 - protein, 20 aa, Artificial Sequence
  Description of Artificial Sequence: Synthetic peptide
  Seed: YMCNSSCMGGMNQRPILTII (TP53 R248Q)
  Core: CMGGMNQRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSXMGXMXQRXILTII

SEQ ID NO: 28461 - protein, 20 aa, Artificial Sequence
  Description of Artificial Sequence: Synthetic peptide
  Seed: YMCNSSCMGGMNQRPILTII (TP53 R248Q)
  Core: MNQRPILTI
  misc_feature (11)..(11): Xaa can be Ala, Cys, Asp, Glu, Phe, His, Ile, Leu, Met, Asn, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNQXPXLTXI

SEQ ID NO: 28462 - protein, 22 aa, Artificial Sequence
  Description of Artificial Sequence: Synthetic peptide
  Seed: YMCNSSCMGGMNQRPILTIITL (TP53 R248Q)
  Core: MNQRPILTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNQXPXLTXITL

SEQ ID NO: 28463 - protein, 24 aa, Artificial Sequence
  Description of Artificial Sequence: Synthetic peptide
  Seed: YMCNSSCMGGMNQRPILTIITLED (TP53 R248Q)
  Core: MNQRPILTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNQXPXLTXITLED

SEQ ID NO: 28464 - protein, 25 aa, Artificial Sequence
  Description of Artificial Sequence: Synthetic peptide
  Seed: YMCNSSCMGGMNQRPILTIITLEDS (TP53 R248Q)
  Core: MNQRPILTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNQXPXLTXITLEDS

SEQ ID NO: 28465 - protein, 20 aa, Artificial Sequence
  Description of Artificial Sequence: Synthetic peptide
  Seed: YNYMCNSSCMGGMNQRPILT (TP53 R248Q)
  Core: CMGGMNQRP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YNYMCNSSXMGXMXQRXILT

SEQ ID NO: 28466 - protein, 23 aa, Artificial Sequence
  Description of Artificial Sequence: Synthetic peptide
  Seed: YNYMCNSSCMGGMNQRPILTIIT (TP53 R248Q)
  Core: MNQRPILTI
  misc_feature (13)..(13): Xaa can be Ala, Cys, Asp, Glu, Phe, His, Ile, Leu, Met, Asn, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YNYMCNSSCMGGXNQXPXLTXIT

SEQ ID NO: 28467 - protein, 24 aa, Artificial Sequence
  Description of Artificial Sequence: Synthetic peptide
  Seed: YNYMCNSSCMGGMNQRPILTIITL (TP53 R248Q)
  Core: MNQRPILTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YNYMCNSSCMGGXNQXPXLTXITL

SEQ ID NO: 28468 - protein, 25 aa, Artificial Sequence
  Description of Artificial Sequence: Synthetic peptide
  Seed: YNYMCNSSCMGGMNQRPILTIITLE (TP53 R248Q)
  Core: MNQRPILTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YNYMCNSSCMGGXNQXPXLTXITLE

SEQ ID NO: 28469 - protein, 14 aa, Artificial Sequence
  Description of Artificial Sequence: Synthetic peptide
  Seed: CMGGMNWRPILTII (TP53 R248W)
  Core: MNWRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNWXPXLTXI

SEQ ID NO: 28470 - protein, 15 aa, Artificial Sequence
  Description of Artificial Sequence: Synthetic peptide
  Seed: CMGGMNWRPILTIIT (TP53 R248W)
  Core: MNWRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNWXPXLTXIT

SEQ ID NO: 28471 - protein, 16 aa, Artificial Sequence
  Description of Artificial Sequence: Synthetic peptide
  Seed: CMGGMNWRPILTIITL (TP53 R248W)
  Core: MNWRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNWXPXLTXITL

SEQ ID NO: 28472 - protein, 17 aa, Artificial Sequence
  Description of Artificial Sequence: Synthetic peptide
  Seed: CMGGMNWRPILTIITLE (TP53 R248W)
  Core: MNWRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNWXPXLTXITLE

SEQ ID NO: 28473 - protein, 18 aa, Artificial Sequence
  Description of Artificial Sequence: Synthetic peptide
  Seed: CMGGMNWRPILTIITLED (TP53 R248W)
  Core: MNWRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNWXPXLTXITLED

SEQ ID NO: 28474 - protein, 19 aa, Artificial Sequence
  Description of Artificial Sequence: Synthetic peptide
  Seed: CMGGMNWRPILTIITLEDS (TP53 R248W)
  Core: MNWRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNWXPXLTXITLEDS

SEQ ID NO: 28475 - protein, 20 aa, Artificial Sequence
  Description of Artificial Sequence: Synthetic peptide
  Seed: CMGGMNWRPILTIITLEDSS (TP53 R248W)
  Core: MNWRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNWXPXLTXITLEDSS

SEQ ID NO: 28476 - protein, 21 aa, Artificial Sequence
  Description of Artificial Sequence: Synthetic peptide
  Seed: CMGGMNWRPILTIITLEDSSG (TP53 R248W)
  Core: MNWRPILTI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CMGGXNWXPXLTXITLEDSSG

SEQ ID NO: 28477 - protein, 17 aa, Artificial Sequence
  Description of Artificial Sequence: Synthetic peptide
  Seed: CNSSCMGGMNWRPILTI (TP53 R248W)
  Core: MNWRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNWXPXLTX

SEQ ID NO: 28478 - protein, 18 aa, Artificial Sequence
  Description of Artificial Sequence: Synthetic peptide
  Seed: CNSSCMGGMNWRPILTII (TP53 R248W)
  Core: MNWRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNWXPXLTXI

SEQ ID NO: 28479 - protein, 19 aa, Artificial Sequence
  Description of Artificial Sequence: Synthetic peptide
  Seed: CNSSCMGGMNWRPILTIIT (TP53 R248W)
  Core: MNWRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNWXPXLTXIT

SEQ ID NO: 28480 - protein, 20 aa, Artificial Sequence
  Description of Artificial Sequence: Synthetic peptide
  Seed: CNSSCMGGMNWRPILTIITL (TP53 R248W)
  Core: MNWRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNWXPXLTXITL

SEQ ID NO: 28481 - protein, 21 aa, Artificial Sequence
  Description of Artificial Sequence: Synthetic peptide
  Seed: CNSSCMGGMNWRPILTIITLE (TP53 R248W)
  Core: MNWRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNWXPXLTXITLE

SEQ ID NO: 28482 - protein, 22 aa, Artificial Sequence
  Description of Artificial Sequence: Synthetic peptide
  Seed: CNSSCMGGMNWRPILTIITLED (TP53 R248W)
  Core: MNWRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNWXPXLTXITLED

SEQ ID NO: 28483 - protein, 23 aa, Artificial Sequence
  Description of Artificial Sequence: Synthetic peptide
  Seed: CNSSCMGGMNWRPILTIITLEDS (TP53 R248W)
  Core: MNWRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNWXPXLTXITLEDS

SEQ ID NO: 28484 - protein, 24 aa, Artificial Sequence
  Description of Artificial Sequence: Synthetic peptide
  Seed: CNSSCMGGMNWRPILTIITLEDSS (TP53 R248W)
  Core: MNWRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNWXPXLTXITLEDSS

SEQ ID NO: 28485 - protein, 25 aa, Artificial Sequence
  Description of Artificial Sequence: Synthetic peptide
  Seed: CNSSCMGGMNWRPILTIITLEDSSG (TP53 R248W)
  Core: MNWRPILTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
CNSSCMGGXNWXPXLTXITLEDSSG

SEQ ID NO: 28486 - protein, 14 aa, Artificial Sequence
  Description of Artificial Sequence: Synthetic peptide
  Seed: GGMNWRPILTIITL (TP53 R248W)
  Core: MNWRPILTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXNWXPXLTXITL

SEQ ID NO: 28487 - protein, 15 aa, Artificial Sequence
  Description of Artificial Sequence: Synthetic peptide
  Seed: GGMNWRPILTIITLE (TP53 R248W)
  Core: MNWRPILTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXNWXPXLTXITLE

SEQ ID NO: 28488 - protein, 16 aa, Artificial Sequence
  Description of Artificial Sequence: Synthetic peptide
  Seed: GGMNWRPILTIITLED (TP53 R248W)
  Core: MNWRPILTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXNWXPXLTXITLED

SEQ ID NO: 28489 - protein, 17 aa, Artificial Sequence
  Description of Artificial Sequence: Synthetic peptide
  Seed: GGMNWRPILTIITLEDS (TP53 R248W)
  Core: MNWRPILTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXNWXPXLTXITLEDS

SEQ ID NO: 28490 - protein, 18 aa, Artificial Sequence
  Description of Artificial Sequence: Synthetic peptide
  Seed: GGMNWRPILTIITLEDSS (TP53 R248W)
  Core: MNWRPILTI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXNWXPXLTXITLEDSS

SEQ ID NO: 28491 - protein, 13 aa, Artificial Sequence
  Description of Artificial Sequence: Synthetic peptide
  Seed: GMNWRPILTIITL (TP53 R248W)
  Core: MNWRPILTI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXNWXPXLTXITL

SEQ ID NO: 28492 - protein, 14 aa, Artificial Sequence
  Description of Artificial Sequence: Synthetic peptide
  Seed: GMNWRPILTIITLE (TP53 R248W)
  Core: MNWRPILTI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXNWXPXLTXITLE

SEQ ID NO: 28493 - protein, 22 aa, Artificial Sequence
  Description of Artificial Sequence: Synthetic peptide
  Seed: HYNYMCNSSCMGGMNWRPILTI (TP53 R248W)
  Core: MNWRPILTI
  misc_feature (14)..(14): Xaa can be Ala, Cys, Asp, Glu, Phe, His, Ile, Lys, Leu, Met, Asn, Gln, Arg, Ser, Thr, Val, Trp, or Ty r
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HYNYMCNSSCMGGXNWXPXLTX

SEQ ID NO: 28494 - protein, 23 aa, Artificial Sequence
  Description of Artificial Sequence: Synthetic peptide
  Seed: HYNYMCNSSCMGGMNWRPILTII (TP53 R248W)
  Core: MNWRPILTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HYNYMCNSSCMGGXNWXPXLTXI

SEQ ID NO: 28495 - protein, 24 aa, Artificial Sequence
  Description of Artificial Sequence: Synthetic peptide
  Seed: HYNYMCNSSCMGGMNWRPILTIIT (TP53 R248W)
  Core: MNWRPILTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HYNYMCNSSCMGGXNWXPXLTXIT

SEQ ID NO: 28496 - protein, 25 aa, Artificial Sequence
  Description of Artificial Sequence: Synthetic peptide
  Seed: HYNYMCNSSCMGGMNWRPILTIITL (TP53 R248W)
  Core: CMGGMNWRP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HYNYMCNSSXMGXMXWRXILTIITL

SEQ ID NO: 28497 - protein, 25 aa, Artificial Sequence
  Description of Artificial Sequence: Synthetic peptide
  Seed: HYNYMCNSSCMGGMNWRPILTIITL (TP53 R248W)
  Core: MNWRPILTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HYNYMCNSSCMGGXNWXPXLTXITL

SEQ ID NO: 28498 - protein, 23 aa, Artificial Sequence
  Description of Artificial Sequence: Synthetic peptide
  Seed: IHYNYMCNSSCMGGMNWRPILTI (TP53 R248W)
  Core: MNWRPILTI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IHYNYMCNSSCMGGXNWXPXLTX

SEQ ID NO: 28499 - protein, 24 aa, Artificial Sequence
  Description of Artificial Sequence: Synthetic peptide
  Seed: IHYNYMCNSSCMGGMNWRPILTII (TP53 R248W)
  Core: MNWRPILTI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IHYNYMCNSSCMGGXNWXPXLTXI

SEQ ID NO: 28500 - protein, 25 aa, Artificial Sequence
  Description of Artificial Sequence: Synthetic peptide
  Seed: IHYNYMCNSSCMGGMNWRPILTIIT (TP53 R248W)
  Core: CMGGMNWRP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IHYNYMCNSSXMGXMXWRXILTIIT

SEQ ID NO: 28501 - protein, 25 aa, Artificial Sequence
  Description of Artificial Sequence: Synthetic peptide
  Seed: IHYNYMCNSSCMGGMNWRPILTIIT (TP53 R248W)
  Core: MNWRPILTI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IHYNYMCNSSCMGGXNWXPXLTXIT

SEQ ID NO: 28502 - protein, 19 aa, Artificial Sequence
  Description of Artificial Sequence: Synthetic peptide
  Seed: MCNSSCMGGMNWRPILTII (TP53 R248W)
  Core: MNWRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNWXPXLTXI

SEQ ID NO: 28503 - protein, 20 aa, Artificial Sequence
  Description of Artificial Sequence: Synthetic peptide
  Seed: MCNSSCMGGMNWRPILTIIT (TP53 R248W)
  Core: MNWRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNWXPXLTXIT

SEQ ID NO: 28504 - protein, 21 aa, Artificial Sequence
  Description of Artificial Sequence: Synthetic peptide
  Seed: MCNSSCMGGMNWRPILTIITL (TP53 R248W)
  Core: MNWRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNWXPXLTXITL

SEQ ID NO: 28505 - protein, 22 aa, Artificial Sequence
  Description of Artificial Sequence: Synthetic peptide
  Seed: MCNSSCMGGMNWRPILTIITLE (TP53 R248W)
  Core: MNWRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNWXPXLTXITLE

SEQ ID NO: 28506 - protein, 23 aa, Artificial Sequence
  Description of Artificial Sequence: Synthetic peptide
  Seed: MCNSSCMGGMNWRPILTIITLED (TP53 R248W)
  Core: MNWRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNWXPXLTXITLED

SEQ ID NO: 28507 - protein, 24 aa, Artificial Sequence
  Description of Artificial Sequence: Synthetic peptide
  Seed: MCNSSCMGGMNWRPILTIITLEDS (TP53 R248W)
  Core: MNWRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNWXPXLTXITLEDS

SEQ ID NO: 28508 - protein, 25 aa, Artificial Sequence
  Description of Artificial Sequence: Synthetic peptide
  Seed: MCNSSCMGGMNWRPILTIITLEDSS (TP53 R248W)
  Core: MNWRPILTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
MCNSSCMGGXNWXPXLTXITLEDSS

SEQ ID NO: 28509 - protein, 13 aa, Artificial Sequence
  Description of Artificial Sequence: Synthetic peptide
  Seed: MGGMNWRPILTII (TP53 R248W)
  Core: MNWRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNWXPXLTXI

SEQ ID NO: 28510 - protein, 14 aa, Artificial Sequence
  Description of Artificial Sequence: Synthetic peptide
  Seed: MGGMNWRPILTIIT (TP53 R248W)
  Core: MNWRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNWXPXLTXIT

SEQ ID NO: 28511 - protein, 15 aa, Artificial Sequence
  Description of Artificial Sequence: Synthetic peptide
  Seed: MGGMNWRPILTIITL (TP53 R248W)
  Core: MNWRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNWXPXLTXITL

SEQ ID NO: 28512 - protein, 16 aa, Artificial Sequence
  Description of Artificial Sequence: Synthetic peptide
  Seed: MGGMNWRPILTIITLE (TP53 R248W)
  Core: MNWRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNWXPXLTXITLE

SEQ ID NO: 28513 - protein, 17 aa, Artificial Sequence
  Description of Artificial Sequence: Synthetic peptide
  Seed: MGGMNWRPILTIITLED (TP53 R248W)
  Core: MNWRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNWXPXLTXITLED

SEQ ID NO: 28514 - protein, 18 aa, Artificial Sequence
  Description of Artificial Sequence: Synthetic peptide
  Seed: MGGMNWRPILTIITLEDS (TP53 R248W)
  Core: MNWRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNWXPXLTXITLEDS

SEQ ID NO: 28515 - protein, 19 aa, Artificial Sequence
  Description of Artificial Sequence: Synthetic peptide
  Seed: MGGMNWRPILTIITLEDSS (TP53 R248W)
  Core: MNWRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNWXPXLTXITLEDSS

SEQ ID NO: 28516 - protein, 20 aa, Artificial Sequence
  Description of Artificial Sequence: Synthetic peptide
  Seed: MGGMNWRPILTIITLEDSSG (TP53 R248W)
  Core: MNWRPILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
MGGXNWXPXLTXITLEDSSG

SEQ ID NO: 28517 - protein, 16 aa, Artificial Sequence
  Description of Artificial Sequence: Synthetic peptide
  Seed: NSSCMGGMNWRPILTI (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTX

SEQ ID NO: 28518 - protein, 17 aa, Artificial Sequence
  Description of Artificial Sequence: Synthetic peptide
  Seed: NSSCMGGMNWRPILTII (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTXI

SEQ ID NO: 28519 - protein, 18 aa, Artificial Sequence
  Description of Artificial Sequence: Synthetic peptide
  Seed: NSSCMGGMNWRPILTIIT (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTXIT

SEQ ID NO: 28520 - protein, 19 aa, Artificial Sequence
  Description of Artificial Sequence: Synthetic peptide
  Seed: NSSCMGGMNWRPILTIITL (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTXITL

SEQ ID NO: 28521 - protein, 20 aa, Artificial Sequence
  Description of Artificial Sequence: Synthetic peptide
  Seed: NSSCMGGMNWRPILTIITLE (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTXITLE

SEQ ID NO: 28522 - protein, 21 aa, Artificial Sequence
  Description of Artificial Sequence: Synthetic peptide
  Seed: NSSCMGGMNWRPILTIITLED (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTXITLED

SEQ ID NO: 28523 - protein, 22 aa, Artificial Sequence
  Description of Artificial Sequence: Synthetic peptide
  Seed: NSSCMGGMNWRPILTIITLEDS (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTXITLEDS

SEQ ID NO: 28524 - protein, 23 aa, Artificial Sequence
  Description of Artificial Sequence: Synthetic peptide
  Seed: NSSCMGGMNWRPILTIITLEDSS (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTXITLEDSS

SEQ ID NO: 28525 - protein, 24 aa, Artificial Sequence
  Description of Artificial Sequence: Synthetic peptide
  Seed: NSSCMGGMNWRPILTIITLEDSSG (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTXITLEDSSG

SEQ ID NO: 28526 - protein, 25 aa, Artificial Sequence
  Description of Artificial Sequence: Synthetic peptide
  Seed: NSSCMGGMNWRPILTIITLEDSSGN (TP53 R248W)
  Core: MNWRPILTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NSSCMGGXNWXPXLTXITLEDSSGN

SEQ ID NO: 28527 - protein, 20 aa, Artificial Sequence
  Description of Artificial Sequence: Synthetic peptide
  Seed: NYMCNSSCMGGMNWRPILTI (TP53 R248W)
  Core: CMGGMNWRP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSXMGXMXWRXILTI

SEQ ID NO: 28528 - protein, 20 aa, Artificial Sequence
  Description of Artificial Sequence: Synthetic peptide
  Seed: NYMCNSSCMGGMNWRPILTI (TP53 R248W)
  Core: MNWRPILTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSCMGGXNWXPXLTX

SEQ ID NO: 28529 - protein, 21 aa, Artificial Sequence
  Description of Artificial Sequence: Synthetic peptide
  Seed: NYMCNSSCMGGMNWRPILTII (TP53 R248W)
  Core: MNWRPILTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSCMGGXNWXPXLTXI

SEQ ID NO: 28530 - protein, 22 aa, Artificial Sequence
  Description of Artificial Sequence: Synthetic peptide
  Seed: NYMCNSSCMGGMNWRPILTIIT (TP53 R248W)
  Core: MNWRPILTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSCMGGXNWXPXLTXIT

SEQ ID NO: 28531 - protein, 23 aa, Artificial Sequence
  Description of Artificial Sequence: Synthetic peptide
  Seed: NYMCNSSCMGGMNWRPILTIITL (TP53 R248W)
  Core: MNWRPILTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSCMGGXNWXPXLTXITL

SEQ ID NO: 28532 - protein, 24 aa, Artificial Sequence
  Description of Artificial Sequence: Synthetic peptide
  Seed: NYMCNSSCMGGMNWRPILTIITLE (TP53 R248W)
  Core: MNWRPILTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSCMGGXNWXPXLTXITLE

SEQ ID NO: 28533 - protein, 25 aa, Artificial Sequence
  Description of Artificial Sequence: Synthetic peptide
  Seed: NYMCNSSCMGGMNWRPILTIITLED (TP53 R248W)
  Core: MNWRPILTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
NYMCNSSCMGGXNWXPXLTXITLED

SEQ ID NO: 28534 - protein, 14 aa, Artificial Sequence
  Description of Artificial Sequence: Synthetic peptide
  Seed: SCMGGMNWRPILTI (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTX

SEQ ID NO: 28535 - protein, 15 aa, Artificial Sequence
  Description of Artificial Sequence: Synthetic peptide
  Seed: SCMGGMNWRPILTII (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXI

SEQ ID NO: 28536 - protein, 16 aa, Artificial Sequence
  Description of Artificial Sequence: Synthetic peptide
  Seed: SCMGGMNWRPILTIIT (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXIT

SEQ ID NO: 28537 - protein, 17 aa, Artificial Sequence
  Description of Artificial Sequence: Synthetic peptide
  Seed: SCMGGMNWRPILTIITL (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXITL

SEQ ID NO: 28538 - protein, 18 aa, Artificial Sequence
  Description of Artificial Sequence: Synthetic peptide
  Seed: SCMGGMNWRPILTIITLE (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXITLE

SEQ ID NO: 28539 - protein, 19 aa, Artificial Sequence
  Description of Artificial Sequence: Synthetic peptide
  Seed: SCMGGMNWRPILTIITLED (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXITLED

SEQ ID NO: 28540 - protein, 20 aa, Artificial Sequence
  Description of Artificial Sequence: Synthetic peptide
  Seed: SCMGGMNWRPILTIITLEDS (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXITLEDS

SEQ ID NO: 28541 - protein, 21 aa, Artificial Sequence
  Description of Artificial Sequence: Synthetic peptide
  Seed: SCMGGMNWRPILTIITLEDSS (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXITLEDSS

SEQ ID NO: 28542 - protein, 22 aa, Artificial Sequence
  Description of Artificial Sequence: Synthetic peptide
  Seed: SCMGGMNWRPILTIITLEDSSG (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXITLEDSSG

SEQ ID NO: 28543 - protein, 23 aa, Artificial Sequence
  Description of Artificial Sequence: Synthetic peptide
  Seed: SCMGGMNWRPILTIITLEDSSGN (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXITLEDSSGN

SEQ ID NO: 28544 - protein, 24 aa, Artificial Sequence
  Description of Artificial Sequence: Synthetic peptide
  Seed: SCMGGMNWRPILTIITLEDSSGNL (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXITLEDSSGNL

SEQ ID NO: 28545 - protein, 25 aa, Artificial Sequence
  Description of Artificial Sequence: Synthetic peptide
  Seed: SCMGGMNWRPILTIITLEDSSGNLL (TP53 R248W)
  Core: MNWRPILTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SCMGGXNWXPXLTXITLEDSSGNLL

SEQ ID NO: 28546 - protein, 15 aa, Artificial Sequence
  Description of Artificial Sequence: Synthetic peptide
  Seed: SSCMGGMNWRPILTI (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTX

SEQ ID NO: 28547 - protein, 16 aa, Artificial Sequence
  Description of Artificial Sequence: Synthetic peptide
  Seed: SSCMGGMNWRPILTII (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXI

SEQ ID NO: 28548 - protein, 17 aa, Artificial Sequence
  Description of Artificial Sequence: Synthetic peptide
  Seed: SSCMGGMNWRPILTIIT (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXIT

SEQ ID NO: 28549 - protein, 18 aa, Artificial Sequence
  Description of Artificial Sequence: Synthetic peptide
  Seed: SSCMGGMNWRPILTIITL (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXITL

SEQ ID NO: 28550 - protein, 19 aa, Artificial Sequence
  Description of Artificial Sequence: Synthetic peptide
  Seed: SSCMGGMNWRPILTIITLE (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXITLE

SEQ ID NO: 28551 - protein, 20 aa, Artificial Sequence
  Description of Artificial Sequence: Synthetic peptide
  Seed: SSCMGGMNWRPILTIITLED (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXITLED

SEQ ID NO: 28552 - protein, 21 aa, Artificial Sequence
  Description of Artificial Sequence: Synthetic peptide
  Seed: SSCMGGMNWRPILTIITLEDS (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXITLEDS

SEQ ID NO: 28553 - protein, 22 aa, Artificial Sequence
  Description of Artificial Sequence: Synthetic peptide
  Seed: SSCMGGMNWRPILTIITLEDSS (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXITLEDSS

SEQ ID NO: 28554 - protein, 23 aa, Artificial Sequence
  Description of Artificial Sequence: Synthetic peptide
  Seed: SSCMGGMNWRPILTIITLEDSSG (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXITLEDSSG

SEQ ID NO: 28555 - protein, 24 aa, Artificial Sequence
  Description of Artificial Sequence: Synthetic peptide
  Seed: SSCMGGMNWRPILTIITLEDSSGN (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXITLEDSSGN

SEQ ID NO: 28556 - protein, 25 aa, Artificial Sequence
  Description of Artificial Sequence: Synthetic peptide
  Seed: SSCMGGMNWRPILTIITLEDSSGNL (TP53 R248W)
  Core: MNWRPILTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSCMGGXNWXPXLTXITLEDSSGNL

SEQ ID NO: 28557 - protein, 25 aa, Artificial Sequence
  Description of Artificial Sequence: Synthetic peptide
  Seed: TIHYNYMCNSSCMGGMNWRPILTII (TP53 R248W)
  Core: CMGGMNWRP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TIHYNYMCNSSXMGXMXWRXILTII

SEQ ID NO: 28558 - protein, 25 aa, Artificial Sequence
  Description of Artificial Sequence: Synthetic peptide
  Seed: TIHYNYMCNSSCMGGMNWRPILTII (TP53 R248W)
  Core: MNWRPILTI
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
TIHYNYMCNSSCMGGXNWXPXLTXI

SEQ ID NO: 28559 - protein, 19 aa, Artificial Sequence
  Description of Artificial Sequence: Synthetic peptide
  Seed: YMCNSSCMGGMNWRPILTI (TP53 R248W)
  Core: MNWRPILTI
  misc_feature (11)..(11): Xaa can be Ala, Cys, Asp, Glu, Phe, His, Ile, Lys, Leu, Met, Asn, Gln, Arg, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNWXPXLTX

SEQ ID NO: 28560 - protein, 20 aa, Artificial Sequence
  Description of Artificial Sequence: Synthetic peptide
  Seed: YMCNSSCMGGMNWRPILTII (TP53 R248W)
  Core: CMGGMNWRP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSXMGXMXWRXILTII

SEQ ID NO: 28561 - protein, 20 aa, Artificial Sequence
  Description of Artificial Sequence: Synthetic peptide
  Seed: YMCNSSCMGGMNWRPILTII (TP53 R248W)
  Core: MNWRPILTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNWXPXLTXI

SEQ ID NO: 28562 - protein, 21 aa, Artificial Sequence
  Description of Artificial Sequence: Synthetic peptide
  Seed: YMCNSSCMGGMNWRPILTIIT (TP53 R248W)
  Core: MNWRPILTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNWXPXLTXIT

SEQ ID NO: 28563 - protein, 22 aa, Artificial Sequence
  Description of Artificial Sequence: Synthetic peptide
  Seed: YMCNSSCMGGMNWRPILTIITL (TP53 R248W)
  Core: MNWRPILTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNWXPXLTXITL

SEQ ID NO: 28564 - protein, 23 aa, Artificial Sequence
  Description of Artificial Sequence: Synthetic peptide
  Seed: YMCNSSCMGGMNWRPILTIITLE (TP53 R248W)
  Core: MNWRPILTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNWXPXLTXITLE

SEQ ID NO: 28565 - protein, 24 aa, Artificial Sequence
  Description of Artificial Sequence: Synthetic peptide
  Seed: YMCNSSCMGGMNWRPILTIITLED (TP53 R248W)
  Core: MNWRPILTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNWXPXLTXITLED

SEQ ID NO: 28566 - protein, 25 aa, Artificial Sequence
  Description of Artificial Sequence: Synthetic peptide
  Seed: YMCNSSCMGGMNWRPILTIITLEDS (TP53 R248W)
  Core: MNWRPILTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YMCNSSCMGGXNWXPXLTXITLEDS

SEQ ID NO: 28567 - protein, 21 aa, Artificial Sequence
  Description of Artificial Sequence: Synthetic peptide
  Seed: YNYMCNSSCMGGMNWRPILTI (TP53 R248W)
  Core: MNWRPILTI
  misc_feature (13)..(13): Xaa can be Ala, Cys, Asp, Glu, Phe, His, Ile, Lys, Leu, Met, Asn, Gln, Arg, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YNYMCNSSCMGGXNWXPXLTX

SEQ ID NO: 28568 - protein, 22 aa, Artificial Sequence
  Description of Artificial Sequence: Synthetic peptide
  Seed: YNYMCNSSCMGGMNWRPILTII (TP53 R248W)
  Core: MNWRPILTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YNYMCNSSCMGGXNWXPXLTXI

SEQ ID NO: 28569 - protein, 23 aa, Artificial Sequence
  Description of Artificial Sequence: Synthetic peptide
  Seed: YNYMCNSSCMGGMNWRPILTIIT (TP53 R248W)
  Core: MNWRPILTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YNYMCNSSCMGGXNWXPXLTXIT

SEQ ID NO: 28570 - protein, 24 aa, Artificial Sequence
  Description of Artificial Sequence: Synthetic peptide
  Seed: YNYMCNSSCMGGMNWRPILTIITL (TP53 R248W)
  Core: MNWRPILTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YNYMCNSSCMGGXNWXPXLTXITL

SEQ ID NO: 28571 - protein, 25 aa, Artificial Sequence
  Description of Artificial Sequence: Synthetic peptide
  Seed: YNYMCNSSCMGGMNWRPILTIITLE (TP53 R248W)
  Core: MNWRPILTI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YNYMCNSSCMGGXNWXPXLTXITLE

SEQ ID NO: 28572 - protein, 20 aa, Artificial Sequence
  Description of Artificial Sequence: Synthetic peptide
  Seed: DSSGNLLGRNSFEVCVCACP (TP53 R273C)
  Core: RNSFEVCVC
  misc_feature (9)..(9): Xaa can be Ala, Phe, His, Ile, Leu, Met, Asn, Gln, Arg, Ser, Val, Trp, or Tyr
  misc_feature (12)..(12): Xaa can be Ala, Cys, Phe, Ile, Leu, Met, Asn, Gln, Ser, Val, Trp, or Tyr
  misc_feature (14)..(14): Xaa can be Ala, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSSGNLLGXNSXEXCVXACP

SEQ ID NO: 28573 - protein, 20 aa, Artificial Sequence
  Description of Artificial Sequence: Synthetic peptide
  Seed: EDSSGNLLGRNSFEVCVCAC (TP53 R273C)
  Core: RNSFEVCVC
  misc_feature (10)..(10): Xaa can be His, Ile, Leu, Met, Asn, Gln, Val, or Tyr
  misc_feature (13)..(13): Xaa can be Ala, Phe, Ile, Leu, Met, Val, Trp, or Tyr
  misc_feature (15)..(15): Xaa can be Ala, Asp, Glu, Phe, Pro, or Trp
  misc_feature (18)..(18): Xaa can be Ala, Cys, Asp, Glu, Phe, Gly, His, Ile, Leu, Met, Asn, Gln, Arg, Ser, Thr, Val, or Tyr
EDSSGNLLGXNSXEXCVXAC

SEQ ID NO: 28574 - protein, 20 aa, Artificial Sequence
  Description of Artificial Sequence: Synthetic peptide
  Seed: LEDSSGNLLGRNSFEVCVCA (TP53 R273C)
  Core: RNSFEVCVC
  misc_feature (11)..(11): Xaa can be Ala, Phe, His, Ile, Leu, Met, Asn, Gln, Arg, Val, Trp, or Tyr
  misc_feature (14)..(14): Xaa can be Ala, Cys, Phe, Ile, Leu, Met, Asn, Gln, Ser, Val, Trp, or Tyr
  misc_feature (16)..(16): Xaa can be Ala, Asp, Glu, Phe, Ile, Lys, Leu, Pro, Thr, Val, Trp, or Tyr
  misc_feature (19)..(19): Xaa can be Ala, Cys, Asp, Glu, Phe, Gly, His, Ile, Leu, Met, Asn, Pro, Gln, Arg, Ser, Thr, Val, Trp, or Tyr
LEDSSGNLLGXNSXEXCVXA

SEQ ID NO: 28575 - protein, 15 aa, Artificial Sequence
  Description of Artificial Sequence: Synthetic peptide
  Seed: LLGRNSFEVCVCACP (TP53 R273C)
  Core: RNSFEVCVC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLGXNSXEXCVXACP

SEQ ID NO: 28576 - protein, 16 aa, Artificial Sequence
  Description of Artificial Sequence: Synthetic peptide
  Seed: NLLGRNSFEVCVCACP (TP53 R273C)
  Core: RNSFEVCVC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NLLGXNSXEXCVXACP

SEQ ID NO: 28577 - protein, 15 aa, Artificial Sequence
  Description of Artificial Sequence: Synthetic peptide
  Seed: SFEVCVCACPGRDRR (TP53 R273C)
  Core: EVCVCACPG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXVCXCXCPXRDRR

SEQ ID NO: 28578 - protein, 20 aa, Artificial Sequence
  Description of Artificial Sequence: Synthetic peptide
  Seed: SGNLLGRNSFEVCVCACPGR (TP53 R273C)
  Core: RNSFEVCVC
  misc_feature (7)..(7): Xaa can be Ala, Cys, Asp, Glu, Phe, His, Ile, Leu, Met, Asn, Gln, Arg, Ser, Thr, Val, Trp, or Tyr
  misc_feature (10)..(10): Xaa can be Ala, Cys, Phe, His, Ile, Leu, Met, Asn, Gln, Ser, Val, Trp, or Tyr
  misc_feature (12)..(12): Xaa can be Ala, Cys, Asp, Glu, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXCVXACPGR

SEQ ID NO: 28579 - protein, 20 aa, Artificial Sequence
  Description of Artificial Sequence: Synthetic peptide
  Seed: SSGNLLGRNSFEVCVCACPG (TP53 R273C)
  Core: RNSFEVCVC
  misc_feature (8)..(8): Xaa can be Ala, Glu, Phe, His, Ile, Leu, Met, Asn, Gln, Arg, Ser, Val, Trp, or Tyr
  misc_feature (11)..(11): Xaa can be Ala, Cys, Phe, Ile, Leu, Met, Asn, Gln, Ser, Val, Trp, or Tyr
  misc_feature (13)..(13): Xaa can be Ala, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGXNSXEXCVXACPG

SEQ ID NO: 28580 - protein, 20 aa, Artificial Sequence
  Description of Artificial Sequence: Synthetic peptide
  Seed: TLEDSSGNLLGRNSFEVCVC (TP53 R273C)
  Core: RNSFEVCVC
  misc_feature (12)..(12): Xaa can be Ile, Leu, Met, Val, or Trp
  misc_feature (15)..(15): Xaa can be Cys, Phe, Ile, Leu, Met, Val, Trp, or Tyr
  misc_feature (17)..(17): Xaa can be Asp, Glu, Phe, Pro, Trp, or Tyr
  misc_feature (20)..(20): Xaa can be Ala, Asp, Glu, Phe, Gly, His, Ile, Leu, Met, Asn, Gln, Ser, Thr, Val, or Tyr
TLEDSSGNLLGXNSXEXCVX

SEQ ID NO: 28581 - protein, 18 aa, Artificial Sequence
  Description of Artificial Sequence: Synthetic peptide
  Seed: DSSGNLLGRNSFEVHVCA (TP53 R273H)
  Core: RNSFEVHVC
  misc_feature (9)..(9): Xaa can be Ala, Cys, Asp, Phe, His, Ile, Leu, Met, Asn, Gln, Arg, Ser, Thr, Val, Trp, or Tyr
  misc_feature (12)..(12): Xaa can be Ala, Cys, Phe, His, Ile, Leu, Met, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, or Trp
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSSGNLLGXNSXEXHVXA

SEQ ID NO: 28582 - protein, 20 aa, Artificial Sequence
  Description of Artificial Sequence: Synthetic peptide
  Seed: DSSGNLLGRNSFEVHVCACP (TP53 R273H)
  Core: RNSFEVHVC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSSGNLLGXNSXEXHVXACP

SEQ ID NO: 28583 - protein, 20 aa, Artificial Sequence
  Description of Artificial Sequence: Synthetic peptide
  Seed: DSSGNLLGRNSFEVHVCACP (TP53 R273H)
  Core: SFEVHVCAC
  misc_feature (11)..(11): Xaa can be Ala, Cys, Phe, His, Ile, Leu, Met, Asn, Gln, Arg, Ser, Thr, Val, Trp, or Tyr
  misc_feature (14)..(14): Xaa can be Ala, Gly, Ile, Ser, Thr, or Val
  misc_feature (16)..(16): Xaa can be Ala, Gly, Ile, Leu, Met, Asn, Pro, Ser, Thr, or Val
  misc_feature (19)..(19): Xaa can be Ala, Asp, Glu, Phe, Gly, His, Ile, Lys, Leu, Met, Asn, Pro, Gln, Arg, Ser, Thr, Val, or Ty r
DSSGNLLGRNXFEXHXCAXP

SEQ ID NO: 28584 - protein, 21 aa, Artificial Sequence
  Description of Artificial Sequence: Synthetic peptide
  Seed: DSSGNLLGRNSFEVHVCACPG (TP53 R273H)
  Core: RNSFEVHVC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSSGNLLGXNSXEXHVXACPG

SEQ ID NO: 28585 - protein, 22 aa, Artificial Sequence
  Description of Artificial Sequence: Synthetic peptide
  Seed: DSSGNLLGRNSFEVHVCACPGR (TP53 R273H)
  Core: RNSFEVHVC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSSGNLLGXNSXEXHVXACPGR

SEQ ID NO: 28586 - protein, 23 aa, Artificial Sequence
  Description of Artificial Sequence: Synthetic peptide
  Seed: DSSGNLLGRNSFEVHVCACPGRD (TP53 R273H)
  Core: RNSFEVHVC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSSGNLLGXNSXEXHVXACPGRD

SEQ ID NO: 28587 - protein, 24 aa, Artificial Sequence
  Description of Artificial Sequence: Synthetic peptide
  Seed: DSSGNLLGRNSFEVHVCACPGRDR (TP53 R273H)
  Core: RNSFEVHVC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSSGNLLGXNSXEXHVXACPGRDR

SEQ ID NO: 28588 - protein, 24 aa, Artificial Sequence
  Description of Artificial Sequence: Synthetic peptide
  Seed: DSSGNLLGRNSFEVHVCACPGRDR (TP53 R273H)
  Core: SFEVHVCAC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Phe, Gly, Ile, Leu, Met, Asn, Ser, Thr, or Val
  misc_feature (16)..(16): Xaa can be Ala, Cys, Ile, Lys, Leu, Met, Asn, Pro, Ser, Thr, or Val
  misc_feature (19)..(19): Xaa can be Ala, Cys, Phe, Gly, His, Ile, Lys, Leu, Met, Asn, Gln, Arg, Ser, Thr, Val, or Tyr
DSSGNLLGRNXFEXHXCAXPGRDR

SEQ ID NO: 28589 - protein, 25 aa, Artificial Sequence
  Description of Artificial Sequence: Synthetic peptide
  Seed: DSSGNLLGRNSFEVHVCACPGRDRR (TP53 R273H)
  Core: RNSFEVHVC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSSGNLLGXNSXEXHVXACPGRDRR

SEQ ID NO: 28590 - protein, 25 aa, Artificial Sequence
  Description of Artificial Sequence: Synthetic peptide
  Seed: DSSGNLLGRNSFEVHVCACPGRDRR (TP53 R273H)
  Core: EVHVCACPG
  misc_feature (13)..(13): Xaa can be Ala, Cys, Asp, Glu, Phe, His, Ile, Leu, Met, Asn, Gln, Ser, Thr, Val, Trp, or Tyr
  misc_feature (16)..(16): Xaa can be Ala, Phe, Gly, His, Ile, Leu, Met, Asn, Gln, Ser, Thr, Val, or Trp
  misc_feature (18)..(18): Xaa can be Ala, Cys, Asp, Glu, Gly, Ile, Leu, Met, Asn, Pro, Ser, Thr, or Val
  misc_feature (21)..(21): Xaa can be Ala, Cys, Asp, Glu, Phe, Gly, His, Ile, Leu, Met, Asn, Pro, Gln, Ser, Thr, Val, Trp, or Ty r
DSSGNLLGRNSFXVHXCXCPXRDRR

SEQ ID NO: 28591 - protein, 25 aa, Artificial Sequence
  Description of Artificial Sequence: Synthetic peptide
  Seed: DSSGNLLGRNSFEVHVCACPGRDRR (TP53 R273H)
  Core: VHVCACPGR
  misc_feature (14)..(14): Xaa can be Ala, Cys, Asp, Glu, Phe, Gly, His, Ile, Leu, Met, Asn, Pro, Gln, Ser, Thr, Val, Trp, or Ty r
  misc_feature (17)..(17): Xaa can be Ala, Cys, Glu, Phe, Gly, His, Ile, Leu, Met, Asn, Pro, Gln, Ser, Thr, Val, Trp, or Tyr
  misc_feature (19)..(19): Xaa can be Ala, Cys, Asp, Glu, Phe, Gly, Ile, Lys, Leu, Met, Asn, Pro, Gln, Ser, Thr, or Val
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DSSGNLLGRNSFEXHVXAXPGXDRR

SEQ ID NO: 28592 - protein, 19 aa, Artificial Sequence
  Description of Artificial Sequence: Synthetic peptide
  Seed: EDSSGNLLGRNSFEVHVCA (TP53 R273H)
  Core: RNSFEVHVC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Leu, Met, Asn, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDSSGNLLGXNSXEXHVXA

SEQ ID NO: 28593 - protein, 20 aa, Artificial Sequence
  Description of Artificial Sequence: Synthetic peptide
  Seed: EDSSGNLLGRNSFEVHVCAC (TP53 R273H)
  Core: RNSFEVHVC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Phe, Gly, His, Ile, Leu, Met, Asn, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDSSGNLLGXNSXEXHVXAC

SEQ ID NO: 28594 - protein, 21 aa, Artificial Sequence
  Description of Artificial Sequence: Synthetic peptide
  Seed: EDSSGNLLGRNSFEVHVCACP (TP53 R273H)
  Core: RNSFEVHVC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDSSGNLLGXNSXEXHVXACP

SEQ ID NO: 28595 - protein, 22 aa, Artificial Sequence
  Description of Artificial Sequence: Synthetic peptide
  Seed: EDSSGNLLGRNSFEVHVCACPG (TP53 R273H)
  Core: RNSFEVHVC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDSSGNLLGXNSXEXHVXACPG

SEQ ID NO: 28596 - protein, 23 aa, Artificial Sequence
  Description of Artificial Sequence: Synthetic peptide
  Seed: EDSSGNLLGRNSFEVHVCACPGR (TP53 R273H)
  Core: RNSFEVHVC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDSSGNLLGXNSXEXHVXACPGR

SEQ ID NO: 28597 - protein, 24 aa, Artificial Sequence
  Description of Artificial Sequence: Synthetic peptide
  Seed: EDSSGNLLGRNSFEVHVCACPGRD (TP53 R273H)
  Core: RNSFEVHVC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDSSGNLLGXNSXEXHVXACPGRD

SEQ ID NO: 28598 - protein, 25 aa, Artificial Sequence
  Description of Artificial Sequence: Synthetic peptide
  Seed: EDSSGNLLGRNSFEVHVCACPGRDR (TP53 R273H)
  Core: RNSFEVHVC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDSSGNLLGXNSXEXHVXACPGRDR

SEQ ID NO: 28599 - protein, 25 aa, Artificial Sequence
  Description of Artificial Sequence: Synthetic peptide
  Seed: EDSSGNLLGRNSFEVHVCACPGRDR (TP53 R273H)
  Core: SFEVHVCAC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Phe, Gly, His, Ile, Leu, Met, Asn, Ser, Thr, Val, or Trp
  misc_feature (17)..(17): Xaa can be Ala, Cys, Gly, Ile, Lys, Leu, Met, Asn, Pro, Gln, Arg, Ser, Thr, or Val
  misc_feature (20)..(20): Xaa can be Ala, Cys, Phe, Gly, His, Ile, Lys, Leu, Met, Asn, Gln, Arg, Ser, Thr, Val, or Tyr
EDSSGNLLGRNXFEXHXCAXPGRDR

SEQ ID NO: 28600 - protein, 25 aa, Artificial Sequence
  Description of Artificial Sequence: Synthetic peptide
  Seed: EDSSGNLLGRNSFEVHVCACPGRDR (TP53 R273H)
  Core: EVHVCACPG
  misc_feature (14)..(14): Xaa can be Ala, Cys, Asp, Glu, Phe, Gly, His, Ile, Lys, Leu, Met, Asn, Gln, Ser, Thr, Val, Trp, or Ty r
  misc_feature (17)..(17): Xaa can be Ala, Phe, Gly, His, Ile, Leu, Met, Asn, Gln, Ser, Thr, Val, Trp, or Tyr
  misc_feature (19)..(19): Xaa can be Ala, Cys, Asp, Glu, Phe, Gly, His, Ile, Leu, Met, Asn, Pro, Ser, Thr, or Val
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDSSGNLLGRNSFXVHXCXCPXRDR

SEQ ID NO: 28601 - protein, 15 aa, Artificial Sequence
  Description of Artificial Sequence: Synthetic peptide
  Seed: FEVHVCACPGRDRRT (TP53 R273H)
  Core: VHVCACPGR
  misc_feature (3)..(3): Xaa can be Ala, Cys, Phe, Ile, Leu, Met, Thr, Val, Trp, or Tyr
  misc_feature (6)..(6): Xaa can be Ala, Cys, Asp, Glu, Phe, Gly, His, Ile, Lys, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FEXHVXAXPGXDRRT

SEQ ID NO: 28602 - protein, 14 aa, Artificial Sequence
  Description of Artificial Sequence: Synthetic peptide
  Seed: GNLLGRNSFEVHVC (TP53 R273H)
  Core: RNSFEVHVC
  misc_feature (6)..(6): Xaa can be Ala, Cys, Asp, Glu, Phe, Gly, His, Ile, Leu, Met, Asn, Pro, Gln, Arg, Ser, Thr, Val, Trp, or Tyr
  misc_feature (9)..(9): Xaa can be Ala, Cys, Phe, Gly, His, Ile, Leu, Met, Asn, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGXNSXEXHVX

SEQ ID NO: 28603 - protein, 15 aa, Artificial Sequence
  Description of Artificial Sequence: Synthetic peptide
  Seed: GNLLGRNSFEVHVCA (TP53 R273H)
  Core: RNSFEVHVC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGXNSXEXHVXA

SEQ ID NO: 28604 - protein, 16 aa, Artificial Sequence
  Description of Artificial Sequence: Synthetic peptide
  Seed: GNLLGRNSFEVHVCAC (TP53 R273H)
  Core: RNSFEVHVC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGXNSXEXHVXAC

SEQ ID NO: 28605 - protein, 17 aa, Artificial Sequence
  Description of Artificial Sequence: Synthetic peptide
  Seed: GNLLGRNSFEVHVCACP (TP53 R273H)
  Core: RNSFEVHVC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGXNSXEXHVXACP

SEQ ID NO: 28606 - protein, 18 aa, Artificial Sequence
  Description of Artificial Sequence: Synthetic peptide
  Seed: GNLLGRNSFEVHVCACPG (TP53 R273H)
  Core: RNSFEVHVC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGXNSXEXHVXACPG

SEQ ID NO: 28607 - protein, 19 aa, Artificial Sequence
  Description of Artificial Sequence: Synthetic peptide
  Seed: GNLLGRNSFEVHVCACPGR (TP53 R273H)
  Core: RNSFEVHVC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGXNSXEXHVXACPGR

SEQ ID NO: 28608 - protein, 20 aa, Artificial Sequence
  Description of Artificial Sequence: Synthetic peptide
  Seed: GNLLGRNSFEVHVCACPGRD (TP53 R273H)
  Core: RNSFEVHVC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGXNSXEXHVXACPGRD

SEQ ID NO: 28609 - protein, 20 aa, Artificial Sequence
  Description of Artificial Sequence: Synthetic peptide
  Seed: GNLLGRNSFEVHVCACPGRD (TP53 R273H)
  Core: SFEVHVCAC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Phe, Gly, His, Ile, Leu, Met, Asn, Gln, Ser, Thr, Val, Trp, or Tyr
  misc_feature (13)..(13): Xaa can be Ala, Cys, Asp, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGRNXFEXHXCAXPGRD

SEQ ID NO: 28610 - protein, 20 aa, Artificial Sequence
  Description of Artificial Sequence: Synthetic peptide
  Seed: GNLLGRNSFEVHVCACPGRD (TP53 R273H)
  Core: EVHVCACPG
  misc_feature (10)..(10): Xaa can be Ala, Cys, Asp, Glu, Phe, His, Ile, Lys, Leu, Met, Asn, Gln, Ser, Thr, Val, Trp, or Tyr
  misc_feature (13)..(13): Xaa can be Ala, Asp, Phe, Gly, His, Ile, Leu, Met, Asn, Gln, Ser, Thr, Val, Trp, or Tyr
  misc_feature (15)..(15): Xaa can be Ala, Cys, Asp, Glu, Gly, His, Ile, Leu, Met, Asn, Pro, Ser, Thr, or Val
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGRNSFXVHXCXCPXRD

SEQ ID NO: 28611 - protein, 23 aa, Artificial Sequence
  Description of Artificial Sequence: Synthetic peptide
  Seed: GNLLGRNSFEVHVCACPGRDRRT (TP53 R273H)
  Core: VHVCACPGR
  misc_feature (11)..(11): Xaa can be Ala, Cys, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGRNSFEXHVXAXPGXDRRT

SEQ ID NO: 28612 - protein, 24 aa, Artificial Sequence
  Description of Artificial Sequence: Synthetic peptide
  Seed: GNLLGRNSFEVHVCACPGRDRRTE (TP53 R273H)
  Core: VHVCACPGR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGRNSFEXHVXAXPGXDRRTE

SEQ ID NO: 28613 - protein, 25 aa, Artificial Sequence
  Description of Artificial Sequence: Synthetic peptide
  Seed: GNLLGRNSFEVHVCACPGRDRRTEE (TP53 R273H)
  Core: VHVCACPGR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNLLGRNSFEXHVXAXPGXDRRTEE

SEQ ID NO: 28614 - protein, 15 aa, Artificial Sequence
  Description of Artificial Sequence: Synthetic peptide
  Seed: GRNSFEVHVCACPGR (TP53 R273H)
  Core: RNSFEVHVC
  misc_feature (2)..(2): Xaa can be Ala, Cys, Asp, Glu, Phe, His, Ile, Leu, Met, Asn, Pro, Gln, Ser, Thr, Val, Trp, or Tyr
  misc_feature (5)..(5): Xaa can be Ala, Phe, His, Ile, Leu, Met, Arg, Ser, Thr, Val, Trp, or Tyr
  misc_feature (7)..(7): Xaa can be Ala, Cys, Glu, Phe, Gly, His, Ile, Lys, Leu, Met, Asn, Pro, Gln, Arg, Ser, Thr, Val, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXNSXEXHVXACPGR

SEQ ID NO: 28615 - protein, 15 aa, Artificial Sequence
  Description of Artificial Sequence: Synthetic peptide
  Seed: GRNSFEVHVCACPGR (TP53 R273H)
  Core: SFEVHVCAC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (9)..(9): Xaa can be Ala, Cys, Phe, Gly, His, Ile, Lys, Leu, Met, Asn, Pro, Gln, Arg, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRNXFEXHXCAXPGR

SEQ ID NO: 28616 - protein, 16 aa, Artificial Sequence
  Description of Artificial Sequence: Synthetic peptide
  Seed: GRNSFEVHVCACPGRD (TP53 R273H)
  Core: VHVCACPGR
  misc_feature (7)..(7): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Phe, Gly, Ile, Leu, Met, Asn, Gln, Ser, Thr, Val, or Trp
  misc_feature (12)..(12): Xaa can be Ala, Cys, Asp, Glu, Phe, Gly, His, Ile, Leu, Met, Asn, Pro, Ser, Thr, Val, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GRNSFEXHVXAXPGXD

SEQ ID NO: 28617 - protein, 20 aa, Artificial Sequence
  Description of Artificial Sequence: Synthetic peptide
  Seed: GRNSFEVHVCACPGRDRRTE (TP53 R273H)
  Core: EVHVCACPG
  misc_feature (6)..(6): Xaa can be Ala, Cys, Asp, Glu, Phe, His, Ile, Leu, Met, Asn, Pro, Gln, Ser, Thr, Val, Trp, or Tyr
  misc_feature (9)..(9): Xaa can be Ala, Cys, Phe, Gly, His, Ile, Leu, Met, Asn, Gln, Ser, Thr, Val, or Trp
  misc_feature (11)..(11): Xaa can be Ala, Cys, Asp, Gly, Ile, Leu, Met, Asn, Pro, Ser, Thr, or Val
  misc_feature (14)..(14): Xaa can be Ala, Cys, Asp, Glu, Phe, Gly, His, Ile, Leu, Met, Asn, Pro, Gln, Ser, Thr, Val, Trp, or Ty r
GRNSFXVHXCXCPXRDRRTE

SEQ ID NO: 28618 - protein, 20 aa, Artificial Sequence
  Description of Artificial Sequence: Synthetic peptide
  Seed: GRNSFEVHVCACPGRDRRTE (TP53 R273H)
  Core: VHVCACPGR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GRNSFEXHVXAXPGXDRRTE

SEQ ID NO: 28619 - protein, 22 aa, Artificial Sequence
  Description of Artificial Sequence: Synthetic peptide
  Seed: IITLEDSSGNLLGRNSFEVHVC (TP53 R273H)
  Core: RNSFEVHVC
  misc_feature (14)..(14): Xaa can be Ala, Phe, Ile, Leu, Met, Asn, Val, Trp, or Tyr
  misc_feature (17)..(17): Xaa can be Ala, Cys, Phe, Ile, Leu, Met, Val, Trp, or Tyr
  misc_feature (19)..(19): Xaa can be Asp, Glu, Phe, His, Ile, Asn, Pro, Thr, Val, Trp, or Tyr
  misc_feature (22)..(22): Xaa can be Ala, Cys, Asp, Glu, Phe, Gly, His, Ile, Leu, Met, Asn, Pro, Gln, Ser, Thr, Val, Trp, or Ty r
IITLEDSSGNLLGXNSXEXHVX

SEQ ID NO: 28620 - protein, 23 aa, Artificial Sequence
  Description of Artificial Sequence: Synthetic peptide
  Seed: IITLEDSSGNLLGRNSFEVHVCA (TP53 R273H)
  Core: RNSFEVHVC
  misc_feature (14)..(14): Xaa can be Ala, Cys, Asp, Phe, His, Ile, Leu, Met, Asn, Gln, Arg, Ser, Thr, Val, Trp, or Tyr
  misc_feature (17)..(17): Xaa can be Ala, Cys, Phe, His, Ile, Leu, Met, Gln, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IITLEDSSGNLLGXNSXEXHVXA

SEQ ID NO: 28621 - protein, 24 aa, Artificial Sequence
  Description of Artificial Sequence: Synthetic peptide
  Seed: IITLEDSSGNLLGRNSFEVHVCAC (TP53 R273H)
  Core: RNSFEVHVC
  misc_feature (14)..(14): Xaa can be Ala, Cys, Phe, His, Ile, Leu, Met, Asn, Gln, Arg, Ser, Thr, Val, Trp, or Tyr
  misc_feature (17)..(17): Xaa can be Ala, Cys, Phe, His, Ile, Leu, Met, Gln, Ser, Thr, Val, Trp, or Tyr
  misc_feature (19)..(19): Xaa can be Ala, Cys, Asp, Glu, Phe, Gly, His, Ile, Lys, Leu, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IITLEDSSGNLLGXNSXEXHVXAC

SEQ ID NO: 28622 - protein, 25 aa, Artificial Sequence
  Description of Artificial Sequence: Synthetic peptide
  Seed: IITLEDSSGNLLGRNSFEVHVCACP (TP53 R273H)
  Core: RNSFEVHVC
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IITLEDSSGNLLGXNSXEXHVXACP

SEQ ID NO: 28623 - protein, 22 aa, Artificial Sequence
  Description of Artificial Sequence: Synthetic peptide
  Seed: ITLEDSSGNLLGRNSFEVHVCA (TP53 R273H)
  Core: RNSFEVHVC
  misc_feature (13)..(13): Xaa can be Ala, Cys, Phe, His, Ile, Leu, Met, Asn, Gln, Arg, Ser, Thr, Val, Trp, or Tyr
  misc_feature (16)..(16): Xaa can be Ala, Cys, Phe, His, Ile, Leu, Met, Gln, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ITLEDSSGNLLGXNSXEXHVXA

SEQ ID NO: 28624 - protein, 23 aa, Artificial Sequence
  Description of Artificial Sequence: Synthetic peptide
  Seed: ITLEDSSGNLLGRNSFEVHVCAC (TP53 R273H)
  Core: RNSFEVHVC
  misc_feature (13)..(13): Xaa can be Ala, Cys, Phe, His, Ile, Leu, Met, Asn, Gln, Arg, Val, Trp, or Tyr
  misc_feature (16)..(16): Xaa can be Ala, Cys, Phe, Ile, Leu, Met, Gln, Ser, Thr, Val, Trp, or Tyr
  misc_feature (18)..(18): Xaa can be Ala, Cys, Asp, Glu, Phe, Gly, His, Ile, Lys, Leu, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ITLEDSSGNLLGXNSXEXHVXAC

SEQ ID NO: 28625 - protein, 24 aa, Artificial Sequence
  Description of Artificial Sequence: Synthetic peptide
  Seed: ITLEDSSGNLLGRNSFEVHVCACP (TP53 R273H)
  Core: RNSFEVHVC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ITLEDSSGNLLGXNSXEXHVXACP

SEQ ID NO: 28626 - protein, 25 aa, Artificial Sequence
  Description of Artificial Sequence: Synthetic peptide
  Seed: ITLEDSSGNLLGRNSFEVHVCACPG (TP53 R273H)
  Core: RNSFEVHVC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ITLEDSSGNLLGXNSXEXHVXACPG

SEQ ID NO: 28627 - protein, 20 aa, Artificial Sequence
  Description of Artificial Sequence: Synthetic peptide
  Seed: LEDSSGNLLGRNSFEVHVCA (TP53 R273H)
  Core: RNSFEVHVC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Phe, Gly, His, Ile, Leu, Met, Asn, Pro, Gln, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LEDSSGNLLGXNSXEXHVXA

SEQ ID NO: 28628 - protein, 22 aa, Artificial Sequence
  Description of Artificial Sequence: Synthetic peptide
  Seed: LEDSSGNLLGRNSFEVHVCACP (TP53 R273H)
  Core: RNSFEVHVC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LEDSSGNLLGXNSXEXHVXACP

SEQ ID NO: 28629 - protein, 23 aa, Artificial Sequence
  Description of Artificial Sequence: Synthetic peptide
  Seed: LEDSSGNLLGRNSFEVHVCACPG (TP53 R273H)
  Core: RNSFEVHVC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LEDSSGNLLGXNSXEXHVXACPG

SEQ ID NO: 28630 - protein, 24 aa, Artificial Sequence
  Description of Artificial Sequence: Synthetic peptide
  Seed: LEDSSGNLLGRNSFEVHVCACPGR (TP53 R273H)
  Core: RNSFEVHVC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LEDSSGNLLGXNSXEXHVXACPGR

SEQ ID NO: 28631 - protein, 24 aa, Artificial Sequence
  Description of Artificial Sequence: Synthetic peptide
  Seed: LEDSSGNLLGRNSFEVHVCACPGR (TP53 R273H)
  Core: SFEVHVCAC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Phe, Gly, His, Ile, Leu, Met, Asn, Ser, Thr, Val, Trp, or Tyr
  misc_feature (18)..(18): Xaa can be Ala, Cys, Phe, Gly, Ile, Lys, Leu, Met, Asn, Pro, Ser, Thr, or Val
  misc_feature (21)..(21): Xaa can be Ala, Cys, Glu, Phe, Gly, His, Ile, Lys, Leu, Met, Asn, Pro, Gln, Arg, Ser, Thr, Val, Trp, or Tyr
LEDSSGNLLGRNXFEXHXCAXPGR

SEQ ID NO: 28632 - protein, 25 aa, Artificial Sequence
  Description of Artificial Sequence: Synthetic peptide
  Seed: LEDSSGNLLGRNSFEVHVCACPGRD (TP53 R273H)
  Core: RNSFEVHVC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LEDSSGNLLGXNSXEXHVXACPGRD

SEQ ID NO: 28633 - protein, 25 aa, Artificial Sequence
  Description of Artificial Sequence: Synthetic peptide
  Seed: LEDSSGNLLGRNSFEVHVCACPGRD (TP53 R273H)
  Core: SFEVHVCAC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Phe, Gly, His, Ile, Leu, Met, Asn, Ser, Thr, Val, or Trp
  misc_feature (18)..(18): Xaa can be Ala, Cys, Phe, Gly, Ile, Lys, Leu, Met, Asn, Pro, Gln, Arg, Ser, Thr, or Val
  misc_feature (21)..(21): Xaa can be Ala, Cys, Asp, Glu, Phe, Gly, His, Ile, Lys, Leu, Met, Asn, Pro, Gln, Arg, Ser, Thr, Val, or Tyr
LEDSSGNLLGRNXFEXHXCAXPGRD

SEQ ID NO: 28634 - protein, 15 aa, Artificial Sequence
  Description of Artificial Sequence: Synthetic peptide
  Seed: LGRNSFEVHVCACPG (TP53 R273H)
  Core: RNSFEVHVC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Phe, Gly, His, Ile, Leu, Met, Asn, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LGXNSXEXHVXACPG

SEQ ID NO: 28635 - protein, 16 aa, Artificial Sequence
  Description of Artificial Sequence: Synthetic peptide
  Seed: LGRNSFEVHVCACPGR (TP53 R273H)
  Core: SFEVHVCAC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Gln, Ser, Thr, Val, Trp, or Tyr
  misc_feature (10)..(10): Xaa can be Ala, Cys, Phe, Gly, Ile, Leu, Met, Asn, Pro, Ser, Thr, Val, or Trp
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LGRNXFEXHXCAXPGR

SEQ ID NO: 28636 - protein, 20 aa, Artificial Sequence
  Description of Artificial Sequence: Synthetic peptide
  Seed: LGRNSFEVHVCACPGRDRRT (TP53 R273H)
  Core: EVHVCACPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LGRNSFXVHXCXCPXRDRRT

SEQ ID NO: 28637 - protein, 20 aa, Artificial Sequence
  Description of Artificial Sequence: Synthetic peptide
  Seed: LGRNSFEVHVCACPGRDRRT (TP53 R273H)
  Core: VHVCACPGR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LGRNSFEXHVXAXPGXDRRT

SEQ ID NO: 28638 - protein, 14 aa, Artificial Sequence
  Description of Artificial Sequence: Synthetic peptide
  Seed: LLGRNSFEVHVCAC (TP53 R273H)
  Core: RNSFEVHVC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLGXNSXEXHVXAC

SEQ ID NO: 28639 - protein, 15 aa, Artificial Sequence
  Description of Artificial Sequence: Synthetic peptide
  Seed: LLGRNSFEVHVCACP (TP53 R273H)
  Core: RNSFEVHVC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLGXNSXEXHVXACP

SEQ ID NO: 28640 - protein, 16 aa, Artificial Sequence
  Description of Artificial Sequence: Synthetic peptide
  Seed: LLGRNSFEVHVCACPG (TP53 R273H)
  Core: RNSFEVHVC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLGXNSXEXHVXACPG

SEQ ID NO: 28641 - protein, 17 aa, Artificial Sequence
  Description of Artificial Sequence: Synthetic peptide
  Seed: LLGRNSFEVHVCACPGR (TP53 R273H)
  Core: RNSFEVHVC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LLGXNSXEXHVXACPGR

SEQ ID NO: 28642 - protein, 20 aa, Artificial Sequence
  Description of Artificial Sequence: Synthetic peptide
  Seed: LLGRNSFEVHVCACPGRDRR (TP53 R273H)
  Core: RNSFEVHVC
  misc_feature (4)..(4): Xaa can be Phe, Ile, Leu, Arg, Val, Trp, or Tyr
  misc_feature (7)..(7): Xaa can be Ala, Asp, Glu, Phe, His, Ile, Lys, Leu, Met, Asn, Gln, Ser, Thr, Val, Trp, or Tyr
  misc_feature (9)..(9): Xaa can be Ala, Phe, Ile, Leu, Met, Pro, Val, Trp, or Tyr
  misc_feature (12)..(12): Xaa can be Ala, Asp, Glu, His, Ile, Lys, Leu, Met, Asn, Gln, Arg, Ser, Thr, or Val
LLGXNSXEXHVXACPGRDRR

SEQ ID NO: 28643 - protein, 20 aa, Artificial Sequence
  Description of Artificial Sequence: Synthetic peptide
  Seed: LLGRNSFEVHVCACPGRDRR (TP53 R273H)
  Core: EVHVCACPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LLGRNSFXVHXCXCPXRDRR

SEQ ID NO: 28644 - protein, 20 aa, Artificial Sequence
  Description of Artificial Sequence: Synthetic peptide
  Seed: LLGRNSFEVHVCACPGRDRR (TP53 R273H)
  Core: VHVCACPGR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LLGRNSFEXHVXAXPGXDRR

SEQ ID NO: 28645 - protein, 14 aa, Artificial Sequence
  Description of Artificial Sequence: Synthetic peptide
  Seed: NLLGRNSFEVHVCA (TP53 R273H)
  Core: RNSFEVHVC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NLLGXNSXEXHVXA

SEQ ID NO: 28646 - protein, 15 aa, Artificial Sequence
  Description of Artificial Sequence: Synthetic peptide
  Seed: NLLGRNSFEVHVCAC (TP53 R273H)
  Core: RNSFEVHVC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NLLGXNSXEXHVXAC

SEQ ID NO: 28647 - protein, 16 aa, Artificial Sequence
  Description of Artificial Sequence: Synthetic peptide
  Seed: NLLGRNSFEVHVCACP (TP53 R273H)
  Core: RNSFEVHVC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NLLGXNSXEXHVXACP

SEQ ID NO: 28648 - protein, 17 aa, Artificial Sequence
  Description of Artificial Sequence: Synthetic peptide
  Seed: NLLGRNSFEVHVCACPG (TP53 R273H)
  Core: RNSFEVHVC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NLLGXNSXEXHVXACPG

SEQ ID NO: 28649 - protein, 19 aa, Artificial Sequence
  Description of Artificial Sequence: Synthetic peptide
  Seed: NLLGRNSFEVHVCACPGRD (TP53 R273H)
  Core: RNSFEVHVC
  misc_feature (5)..(5): Xaa can be Ala, Cys, Asp, Glu, Phe, His, Ile, Lys, Leu, Met, Pro, Gln, Arg, Ser, Thr, Val, Trp, or Ty r
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Glu, Phe, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NLLGXNSXEXHVXACPGRD

SEQ ID NO: 28650 - protein, 20 aa, Artificial Sequence
  Description of Artificial Sequence: Synthetic peptide
  Seed: NLLGRNSFEVHVCACPGRDR (TP53 R273H)
  Core: RNSFEVHVC
  misc_feature (5)..(5): Xaa can be Ala, Cys, Asp, Glu, Phe, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Glu, Phe, His, Ile, Lys, Leu, Met, Asn, Pro, Gln, Arg, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NLLGXNSXEXHVXACPGRDR

SEQ ID NO: 28651 - protein, 20 aa, Artificial Sequence
  Description of Artificial Sequence: Synthetic peptide
  Seed: NLLGRNSFEVHVCACPGRDR (TP53 R273H)
  Core: SFEVHVCAC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Phe, Gly, His, Ile, Leu, Met, Asn, Ser, Thr, Val, or Trp
  misc_feature (12)..(12): Xaa can be Ala, Cys, Asp, Phe, His, Ile, Lys, Leu, Met, Asn, Pro, Gln, Arg, Ser, Thr, or Val
  misc_feature (15)..(15): Xaa can be Ala, Cys, Asp, Glu, Phe, Gly, His, Ile, Lys, Leu, Met, Asn, Pro, Gln, Arg, Ser, Thr, Val, or Tyr
NLLGRNXFEXHXCAXPGRDR

SEQ ID NO: 28652 - protein, 20 aa, Artificial Sequence
  Description of Artificial Sequence: Synthetic peptide
  Seed: NLLGRNSFEVHVCACPGRDR (TP53 R273H)
  Core: EVHVCACPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NLLGRNSFXVHXCXCPXRDR

SEQ ID NO: 28653 - protein, 24 aa, Artificial Sequence
  Description of Artificial Sequence: Synthetic peptide
  Seed: NLLGRNSFEVHVCACPGRDRRTEE (TP53 R273H)
  Core: VHVCACPGR
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (13)..(13): Xaa can be Ala, Cys, Glu, Phe, Gly, His, Ile, Leu, Met, Asn, Pro, Gln, Ser, Thr, Val, Trp, or Tyr
  misc_feature (15)..(15): Xaa can be Ala, Cys, Asp, Glu, Phe, Gly, Ile, Leu, Met, Asn, Pro, Gln, Ser, Thr, or Val
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NLLGRNSFEXHVXAXPGXDRRTEE

SEQ ID NO: 28654 - protein, 25 aa, Artificial Sequence
  Description of Artificial Sequence: Synthetic peptide
  Seed: NLLGRNSFEVHVCACPGRDRRTEEE (TP53 R273H)
  Core: VHVCACPGR
  misc_feature (10)..(10): Xaa can be Ala, Cys, Asp, Glu, Phe, Gly, His, Ile, Leu, Met, Asn, Pro, Gln, Ser, Thr, Val, Trp, or Ty r
  misc_feature (13)..(13): Xaa can be Ala, Cys, Glu, Phe, Gly, His, Ile, Leu, Met, Asn, Pro, Gln, Ser, Thr, Val, Trp, or Tyr
  misc_feature (15)..(15): Xaa can be Ala, Cys, Asp, Glu, Phe, Gly, Ile, Leu, Met, Asn, Pro, Gln, Ser, Thr, or Val
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
NLLGRNSFEXHVXAXPGXDRRTEEE

SEQ ID NO: 28655 - protein, 15 aa, Artificial Sequence
  Description of Artificial Sequence: Synthetic peptide
  Seed: NSFEVHVCACPGRDR (TP53 R273H)
  Core: EVHVCACPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Phe, Gly, His, Ile, Lys, Leu, Met, Asn, Gln, Arg, Ser, Thr, Val, Trp, or Tyr
  misc_feature (9)..(9): Xaa can be Ala, Cys, Asp, Glu, Phe, Gly, His, Ile, Leu, Met, Asn, Pro, Gln, Ser, Thr, Val, Trp, or Ty r
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NSFXVHXCXCPXRDR

SEQ ID NO: 28656 - protein, 15 aa, Artificial Sequence
  Description of Artificial Sequence: Synthetic peptide
  Seed: NSFEVHVCACPGRDR (TP53 R273H)
  Core: VHVCACPGR
  misc_feature (5)..(5): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Leu, Met, Asn, Pro, Gln, Ser, Thr, Val, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSFEXHVXAXPGXDR

SEQ ID NO: 28657 - protein, 16 aa, Artificial Sequence
  Description of Artificial Sequence: Synthetic peptide
  Seed: NSFEVHVCACPGRDRR (TP53 R273H)
  Core: VHVCACPGR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Leu, Met, Asn, Pro, Gln, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSFEXHVXAXPGXDRR

SEQ ID NO: 28658 - protein, 20 aa, Artificial Sequence
  Description of Artificial Sequence: Synthetic peptide
  Seed: NSFEVHVCACPGRDRRTEEE (TP53 R273H)
  Core: VHVCACPGR
  misc_feature (5)..(5): Xaa can be Ala, Cys, Asp, Glu, Phe, Gly, His, Ile, Lys, Leu, Met, Asn, Pro, Gln, Ser, Thr, Val, Trp, or Tyr
  misc_feature (8)..(8): Xaa can be Ala, Cys, Phe, Gly, His, Ile, Leu, Met, Asn, Gln, Ser, Thr, Val, Trp, or Tyr
  misc_feature (10)..(10): Xaa can be Ala, Cys, Asp, Glu, Phe, Gly, Ile, Leu, Met, Asn, Pro, Gln, Ser, Thr, Val, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
NSFEXHVXAXPGXDRRTEEE

SEQ ID NO: 28659 - protein, 15 aa, Artificial Sequence
  Description of Artificial Sequence: Synthetic peptide
  Seed: RNSFEVHVCACPGRD (TP53 R273H)
  Core: EVHVCACPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Phe, Gly, His, Ile, Lys, Leu, Met, Asn, Pro, Gln, Arg, Ser, Thr, Val, Trp, or Ty r
  misc_feature (10)..(10): Xaa can be Ala, Cys, Asp, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNSFXVHXCXCPXRD

SEQ ID NO: 28660 - protein, 15 aa, Artificial Sequence
  Description of Artificial Sequence: Synthetic peptide
  Seed: RNSFEVHVCACPGRD (TP53 R273H)
  Core: VHVCACPGR
  misc_feature (6)..(6): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, Ile, Leu, Met, Asn, Pro, Gln, Ser, Thr, Val, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RNSFEXHVXAXPGXD

SEQ ID NO: 28661 - protein, 16 aa, Artificial Sequence
  Description of Artificial Sequence: Synthetic peptide
  Seed: RNSFEVHVCACPGRDR (TP53 R273H)
  Core: EVHVCACPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Phe, Gly, His, Ile, Lys, Leu, Met, Asn, Gln, Ser, Thr, Val, Trp, or Tyr
  misc_feature (10)..(10): Xaa can be Ala, Cys, Asp, Phe, Gly, His, Ile, Lys, Leu, Met, Asn, Pro, Gln, Ser, Thr, Val, Trp, or Ty r
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNSFXVHXCXCPXRDR

SEQ ID NO: 28662 - protein, 16 aa, Artificial Sequence
  Description of Artificial Sequence: Synthetic peptide
  Seed: RNSFEVHVCACPGRDR (TP53 R273H)
  Core: VHVCACPGR
  misc_feature (6)..(6): Xaa can be Ala, Cys, Asp, Glu, Phe, Gly, His, Ile, Lys, Leu, Met, Asn, Pro, Gln, Ser, Thr, Val, Trp, or Tyr
  misc_feature (9)..(9): Xaa can be Ala, Cys, Asp, Glu, Phe, Gly, Ile, Leu, Met, Asn, Pro, Gln, Ser, Thr, Val, Trp, or Tyr
  misc_feature (11)..(11): Xaa can be Ala, Cys, Asp, Glu, Phe, Gly, Ile, Lys, Leu, Met, Asn, Pro, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RNSFEXHVXAXPGXDR

SEQ ID NO: 28663 - protein, 17 aa, Artificial Sequence
  Description of Artificial Sequence: Synthetic peptide
  Seed: RNSFEVHVCACPGRDRR (TP53 R273H)
  Core: VHVCACPGR
  misc_feature (6)..(6): Xaa can be Ala, Cys, Asp, Glu, Phe, Gly, His, Ile, Leu, Met, Asn, Pro, Gln, Ser, Thr, Val, Trp, or Ty r
  misc_feature (9)..(9): Xaa can be Ala, Cys, Glu, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, Ile, Leu, Met, Asn, Pro, Gln, Ser, Thr, or Val
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RNSFEXHVXAXPGXDRR

SEQ ID NO: 28664 - protein, 20 aa, Artificial Sequence
  Description of Artificial Sequence: Synthetic peptide
  Seed: RNSFEVHVCACPGRDRRTEE (TP53 R273H)
  Core: VHVCACPGR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Ser, Thr, Val, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RNSFEXHVXAXPGXDRRTEE

SEQ ID NO: 28665 - protein, 15 aa, Artificial Sequence
  Description of Artificial Sequence: Synthetic peptide
  Seed: SFEVHVCACPGRDRR (TP53 R273H)
  Core: VHVCACPGR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFEXHVXAXPGXDRR

SEQ ID NO: 28666 - protein, 16 aa, Artificial Sequence
  Description of Artificial Sequence: Synthetic peptide
  Seed: SFEVHVCACPGRDRRT (TP53 R273H)
  Core: VHVCACPGR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFEXHVXAXPGXDRRT

SEQ ID NO: 28667 - protein, 16 aa, Artificial Sequence
  Description of Artificial Sequence: Synthetic peptide
  Seed: SGNLLGRNSFEVHVCA (TP53 R273H)
  Core: RNSFEVHVC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXA

SEQ ID NO: 28668 - protein, 17 aa, Artificial Sequence
  Description of Artificial Sequence: Synthetic peptide
  Seed: SGNLLGRNSFEVHVCAC (TP53 R273H)
  Core: RNSFEVHVC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Phe, Gly, His, Ile, Leu, Met, Asn, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXAC

SEQ ID NO: 28669 - protein, 18 aa, Artificial Sequence
  Description of Artificial Sequence: Synthetic peptide
  Seed: SGNLLGRNSFEVHVCACP (TP53 R273H)
  Core: RNSFEVHVC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Phe, Gly, His, Ile, Leu, Met, Asn, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXACP

SEQ ID NO: 28670 - protein, 19 aa, Artificial Sequence
  Description of Artificial Sequence: Synthetic peptide
  Seed: SGNLLGRNSFEVHVCACPG (TP53 R273H)
  Core: RNSFEVHVC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXACPG

SEQ ID NO: 28671 - protein, 20 aa, Artificial Sequence
  Description of Artificial Sequence: Synthetic peptide
  Seed: SGNLLGRNSFEVHVCACPGR (TP53 R273H)
  Core: RNSFEVHVC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXACPGR

SEQ ID NO: 28672 - protein, 20 aa, Artificial Sequence
  Description of Artificial Sequence: Synthetic peptide
  Seed: SGNLLGRNSFEVHVCACPGR (TP53 R273H)
  Core: SFEVHVCAC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Phe, Gly, His, Ile, Leu, Met, Asn, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGRNXFEXHXCAXPGR

SEQ ID NO: 28673 - protein, 21 aa, Artificial Sequence
  Description of Artificial Sequence: Synthetic peptide
  Seed: SGNLLGRNSFEVHVCACPGRD (TP53 R273H)
  Core: RNSFEVHVC
  misc_feature (7)..(7): Xaa can be Ala, Cys, Asp, Glu, Phe, His, Ile, Lys, Leu, Met, Asn, Gln, Arg, Ser, Thr, Val, Trp, or Ty r
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Glu, Phe, His, Ile, Leu, Met, Asn, Pro, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXACPGRD

SEQ ID NO: 28674 - protein, 22 aa, Artificial Sequence
  Description of Artificial Sequence: Synthetic peptide
  Seed: SGNLLGRNSFEVHVCACPGRDR (TP53 R273H)
  Core: RNSFEVHVC
  misc_feature (7)..(7): Xaa can be Ala, Cys, Asp, Glu, Phe, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Glu, Phe, His, Ile, Lys, Leu, Met, Asn, Pro, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXACPGRDR

SEQ ID NO: 28675 - protein, 23 aa, Artificial Sequence
  Description of Artificial Sequence: Synthetic peptide
  Seed: SGNLLGRNSFEVHVCACPGRDRR (TP53 R273H)
  Core: RNSFEVHVC
  misc_feature (7)..(7): Xaa can be Ala, Cys, Asp, Glu, Phe, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Glu, Phe, His, Ile, Lys, Leu, Met, Asn, Pro, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXACPGRDRR

SEQ ID NO: 28676 - protein, 23 aa, Artificial Sequence
  Description of Artificial Sequence: Synthetic peptide
  Seed: SGNLLGRNSFEVHVCACPGRDRR (TP53 R273H)
  Core: VHVCACPGR
  misc_feature (12)..(12): Xaa can be Ala, Cys, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGRNSFEXHVXAXPGXDRR

SEQ ID NO: 28677 - protein, 24 aa, Artificial Sequence
  Description of Artificial Sequence: Synthetic peptide
  Seed: SGNLLGRNSFEVHVCACPGRDRRT (TP53 R273H)
  Core: RNSFEVHVC
  misc_feature (7)..(7): Xaa can be Ala, Cys, Asp, Glu, Phe, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Glu, Phe, His, Ile, Lys, Leu, Met, Asn, Pro, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXACPGRDRRT

SEQ ID NO: 28678 - protein, 24 aa, Artificial Sequence
  Description of Artificial Sequence: Synthetic peptide
  Seed: SGNLLGRNSFEVHVCACPGRDRRT (TP53 R273H)
  Core: VHVCACPGR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGRNSFEXHVXAXPGXDRRT

SEQ ID NO: 28679 - protein, 25 aa, Artificial Sequence
  Description of Artificial Sequence: Synthetic peptide
  Seed: SGNLLGRNSFEVHVCACPGRDRRTE (TP53 R273H)
  Core: RNSFEVHVC
  misc_feature (7)..(7): Xaa can be Ala, Cys, Asp, Glu, Phe, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Glu, Phe, His, Ile, Leu, Met, Asn, Pro, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGXNSXEXHVXACPGRDRRTE

SEQ ID NO: 28680 - protein, 25 aa, Artificial Sequence
  Description of Artificial Sequence: Synthetic peptide
  Seed: SGNLLGRNSFEVHVCACPGRDRRTE (TP53 R273H)
  Core: EVHVCACPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGRNSFXVHXCXCPXRDRRTE

SEQ ID NO: 28681 - protein, 25 aa, Artificial Sequence
  Description of Artificial Sequence: Synthetic peptide
  Seed: SGNLLGRNSFEVHVCACPGRDRRTE (TP53 R273H)
  Core: VHVCACPGR
  misc_feature (12)..(12): Xaa can be Ala, Cys, Asp, Glu, Phe, Gly, His, Ile, Lys, Leu, Met, Asn, Pro, Gln, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGNLLGRNSFEXHVXAXPGXDRRTE

SEQ ID NO: 28682 - protein, 17 aa, Artificial Sequence
  Description of Artificial Sequence: Synthetic peptide
  Seed: SSGNLLGRNSFEVHVCA (TP53 R273H)
  Core: RNSFEVHVC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGXNSXEXHVXA

SEQ ID NO: 28683 - protein, 19 aa, Artificial Sequence
  Description of Artificial Sequence: Synthetic peptide
  Seed: SSGNLLGRNSFEVHVCACP (TP53 R273H)
  Core: RNSFEVHVC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGXNSXEXHVXACP

SEQ ID NO: 28684 - protein, 20 aa, Artificial Sequence
  Description of Artificial Sequence: Synthetic peptide
  Seed: SSGNLLGRNSFEVHVCACPG (TP53 R273H)
  Core: RNSFEVHVC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGXNSXEXHVXACPG

SEQ ID NO: 28685 - protein, 20 aa, Artificial Sequence
  Description of Artificial Sequence: Synthetic peptide
  Seed: SSGNLLGRNSFEVHVCACPG (TP53 R273H)
  Core: SFEVHVCAC
  misc_feature (10)..(10): Xaa can be Ala, Cys, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Phe, Gly, His, Ile, Leu, Met, Asn, Gln, Ser, Thr, Val, Trp, or Tyr
  misc_feature (15)..(15): Xaa can be Ala, Cys, Phe, Gly, His, Ile, Lys, Leu, Met, Asn, Pro, Gln, Arg, Ser, Thr, or Val
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGRNXFEXHXCAXPG

SEQ ID NO: 28686 - protein, 21 aa, Artificial Sequence
  Description of Artificial Sequence: Synthetic peptide
  Seed: SSGNLLGRNSFEVHVCACPGR (TP53 R273H)
  Core: RNSFEVHVC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGXNSXEXHVXACPGR

SEQ ID NO: 28687 - protein, 22 aa, Artificial Sequence
  Description of Artificial Sequence: Synthetic peptide
  Seed: SSGNLLGRNSFEVHVCACPGRD (TP53 R273H)
  Core: RNSFEVHVC
  misc_feature (8)..(8): Xaa can be Ala, Cys, Asp, Glu, Phe, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Glu, Phe, His, Ile, Lys, Leu, Met, Asn, Pro, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGXNSXEXHVXACPGRD

SEQ ID NO: 28688 - protein, 23 aa, Artificial Sequence
  Description of Artificial Sequence: Synthetic peptide
  Seed: SSGNLLGRNSFEVHVCACPGRDR (TP53 R273H)
  Core: RNSFEVHVC
  misc_feature (8)..(8): Xaa can be Ala, Cys, Asp, Glu, Phe, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Asp, Glu, Phe, His, Ile, Lys, Leu, Met, Asn, Pro, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGXNSXEXHVXACPGRDR

SEQ ID NO: 28689 - protein, 24 aa, Artificial Sequence
  Description of Artificial Sequence: Synthetic peptide
  Seed: SSGNLLGRNSFEVHVCACPGRDRR (TP53 R273H)
  Core: RNSFEVHVC
  misc_feature (8)..(8): Xaa can be Ala, Cys, Asp, Glu, Phe, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, His, Ile, Lys, Leu, Met, Asn, Pro, Gln, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGXNSXEXHVXACPGRDRR

SEQ ID NO: 28690 - protein, 25 aa, Artificial Sequence
  Description of Artificial Sequence: Synthetic peptide
  Seed: SSGNLLGRNSFEVHVCACPGRDRRT (TP53 R273H)
  Core: RNSFEVHVC
  misc_feature (8)..(8): Xaa can be Ala, Cys, Asp, Glu, Phe, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, His, Ile, Lys, Leu, Met, Asn, Pro, Gln, Ser, Thr, Val, Trp, or Ty r
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGXNSXEXHVXACPGRDRRT

SEQ ID NO: 28691 - protein, 25 aa, Artificial Sequence
  Description of Artificial Sequence: Synthetic peptide
  Seed: SSGNLLGRNSFEVHVCACPGRDRRT (TP53 R273H)
  Core: VHVCACPGR
  misc_feature (13)..(13): Xaa can be Ala, Cys, Asp, Glu, Phe, Gly, His, Ile, Leu, Met, Asn, Pro, Gln, Ser, Thr, Val, Trp, or Ty r
  misc_feature (16)..(16): Xaa can be Ala, Cys, Glu, Phe, Gly, His, Ile, Leu, Met, Asn, Pro, Gln, Ser, Thr, Val, Trp, or Tyr
  misc_feature (18)..(18): Xaa can be Ala, Cys, Asp, Glu, Phe, Gly, Ile, Leu, Met, Asn, Pro, Gln, Ser, Thr, or Val
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SSGNLLGRNSFEXHVXAXPGXDRRT

SEQ ID NO: 28692 - protein, 20 aa, Artificial Sequence
  Description of Artificial Sequence: Synthetic peptide
  Seed: TLEDSSGNLLGRNSFEVHVC (TP53 R273H)
  Core: RNSFEVHVC
  misc_feature (12)..(12): Xaa can be Ala, Cys, Phe, His, Ile, Leu, Met, Asn, Arg, Ser, Thr, Val, Trp, or Tyr
  misc_feature (15)..(15): Xaa can be Ala, Cys, Phe, Ile, Leu, Met, Ser, Thr, Val, Trp, or Tyr
  misc_feature (17)..(17): Xaa can be Asp, Glu, Phe, His, Ile, Leu, Met, Asn, Pro, Thr, Val, Trp, or Tyr
  misc_feature (20)..(20): Xaa can be Ala, Cys, Asp, Glu, Phe, Gly, His, Ile, Leu, Met, Asn, Pro, Gln, Ser, Thr, Val, Trp, or Ty r
TLEDSSGNLLGXNSXEXHVX

SEQ ID NO: 28693 - protein, 21 aa, Artificial Sequence
  Description of Artificial Sequence: Synthetic peptide
  Seed: TLEDSSGNLLGRNSFEVHVCA (TP53 R273H)
  Core: RNSFEVHVC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Leu, Met, Asn, Gln, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TLEDSSGNLLGXNSXEXHVXA

SEQ ID NO: 28694 - protein, 23 aa, Artificial Sequence
  Description of Artificial Sequence: Synthetic peptide
  Seed: TLEDSSGNLLGRNSFEVHVCACP (TP53 R273H)
  Core: RNSFEVHVC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TLEDSSGNLLGXNSXEXHVXACP

SEQ ID NO: 28695 - protein, 24 aa, Artificial Sequence
  Description of Artificial Sequence: Synthetic peptide
  Seed: TLEDSSGNLLGRNSFEVHVCACPG (TP53 R273H)
  Core: RNSFEVHVC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TLEDSSGNLLGXNSXEXHVXACPG

SEQ ID NO: 28696 - protein, 25 aa, Artificial Sequence
  Description of Artificial Sequence: Synthetic peptide
  Seed: TLEDSSGNLLGRNSFEVHVCACPGR (TP53 R273H)
  Core: RNSFEVHVC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TLEDSSGNLLGXNSXEXHVXACPGR

SEQ ID NO: 28697 - protein, 25 aa, Artificial Sequence
  Description of Artificial Sequence: Synthetic peptide
  Seed: TLEDSSGNLLGRNSFEVHVCACPGR (TP53 R273H)
  Core: SFEVHVCAC
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Phe, Gly, His, Ile, Leu, Met, Asn, Ser, Thr, Val, or Trp
  misc_feature (19)..(19): Xaa can be Ala, Cys, Phe, Gly, Ile, Lys, Leu, Met, Asn, Pro, Gln, Arg, Ser, Thr, or Val
  misc_feature (22)..(22): Xaa can be Ala, Cys, Asp, Glu, Phe, Gly, His, Ile, Lys, Leu, Met, Asn, Pro, Gln, Arg, Ser, Thr, Val, or Tyr
TLEDSSGNLLGRNXFEXHXCAXPGR

SEQ ID NO: 28698 - protein, 15 aa, Artificial Sequence
  Description of Artificial Sequence: Synthetic peptide
  Seed: EVRVCACPGRDWRTE (TP53 R282W)
  Core: ACPGRDWRT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Phe, Gly, His, Ile, Leu, Met, Asn, Pro, Gln, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EVRVCXCPXRXWRXE

SEQ ID NO: 28699 - protein, 16 aa, Artificial Sequence
  Description of Artificial Sequence: Synthetic peptide
  Seed: EVRVCACPGRDWRTEE (TP53 R282W)
  Core: ACPGRDWRT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Phe, Gly, His, Ile, Leu, Met, Asn, Pro, Ser, Thr, Val, Trp, or Tyr
  misc_feature (11)..(11): Xaa can be Ala, Cys, Asp, Phe, Gly, Ile, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EVRVCXCPXRXWRXEE

SEQ ID NO: 28700 - protein, 17 aa, Artificial Sequence
  Description of Artificial Sequence: Synthetic peptide
  Seed: FEVRVCACPGRDWRTEE (TP53 R282W)
  Core: ACPGRDWRT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Phe, Gly, His, Ile, Leu, Met, Asn, Pro, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FEVRVCXCPXRXWRXEE

SEQ ID NO: 28701 - protein, 19 aa, Artificial Sequence
  Description of Artificial Sequence: Synthetic peptide
  Seed: FEVRVCACPGRDWRTEEEN (TP53 R282W)
  Core: ACPGRDWRT
  misc_feature (7)..(7): Xaa can be Ala, Cys, Asp, Glu, Phe, Gly, His, Ile, Lys, Leu, Met, Asn, Pro, Gln, Ser, Thr, Val, Trp, or Tyr
  misc_feature (10)..(10): Xaa can be Ala, Cys, Phe, Gly, His, Ile, Leu, Met, Asn, Ser, Thr, Val, or Trp
  misc_feature (12)..(12): Xaa can be Ala, Cys, Asp, Phe, Gly, Ile, Leu, Met, Asn, Pro, Ser, Thr, Val, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FEVRVCXCPXRXWRXEEEN

SEQ ID NO: 28702 - protein, 20 aa, Artificial Sequence
  Description of Artificial Sequence: Synthetic peptide
  Seed: FEVRVCACPGRDWRTEEENL (TP53 R282W)
  Core: ACPGRDWRT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Phe, Gly, His, Ile, Leu, Met, Asn, Pro, Gln, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FEVRVCXCPXRXWRXEEENL

SEQ ID NO: 28703 - protein, 20 aa, Artificial Sequence
  Description of Artificial Sequence: Synthetic peptide
  Seed: NSFEVRVCACPGRDWRTEEE (TP53 R282W)
  Core: ACPGRDWRT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Phe, Gly, His, Ile, Leu, Met, Asn, Pro, Gln, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSFEVRVCXCPXRXWRXEEE

SEQ ID NO: 28704 - protein, 21 aa, Artificial Sequence
  Description of Artificial Sequence: Synthetic peptide
  Seed: NSFEVRVCACPGRDWRTEEEN (TP53 R282W)
  Core: ACPGRDWRT
  misc_feature (9)..(9): Xaa can be Ala, Cys, Glu, Phe, Gly, His, Ile, Lys, Leu, Met, Asn, Pro, Gln, Ser, Thr, Val, Trp, or Ty r
  misc_feature (12)..(12): Xaa can be Ala, Phe, Gly, His, Ile, Leu, Met, Asn, Ser, Thr, or Val
  misc_feature (14)..(14): Xaa can be Ala, Cys, Phe, Gly, Ile, Leu, Met, Asn, Pro, Ser, Thr, or Val
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSFEVRVCXCPXRXWRXEEEN

SEQ ID NO: 28705 - protein, 22 aa, Artificial Sequence
  Description of Artificial Sequence: Synthetic peptide
  Seed: NSFEVRVCACPGRDWRTEEENL (TP53 R282W)
  Core: ACPGRDWRT
  misc_feature (9)..(9): Xaa can be Ala, Cys, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Phe, Gly, His, Ile, Leu, Met, Asn, Ser, Thr, or Val
  misc_feature (14)..(14): Xaa can be Ala, Cys, Phe, Gly, Ile, Leu, Met, Asn, Pro, Ser, Thr, or Val
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
NSFEVRVCXCPXRXWRXEEENL

SEQ ID NO: 28706 - protein, 22 aa, Artificial Sequence
  Description of Artificial Sequence: Synthetic peptide
  Seed: RNSFEVRVCACPGRDWRTEEEN (TP53 R282W)
  Core: ACPGRDWRT
  misc_feature (10)..(10): Xaa can be Ala, Cys, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Phe, Gly, His, Ile, Leu, Met, Asn, Ser, Thr, or Val
  misc_feature (15)..(15): Xaa can be Ala, Cys, Asp, Phe, Gly, Ile, Leu, Met, Asn, Pro, Ser, Thr, Val, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RNSFEVRVCXCPXRXWRXEEEN

SEQ ID NO: 28707 - protein, 23 aa, Artificial Sequence
  Description of Artificial Sequence: Synthetic peptide
  Seed: RNSFEVRVCACPGRDWRTEEENL (TP53 R282W)
  Core: ACPGRDWRT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Phe, Gly, His, Ile, Leu, Met, Asn, Ser, Thr, Val, or Trp
  misc_feature (15)..(15): Xaa can be Ala, Cys, Asp, Phe, Gly, Ile, Leu, Met, Asn, Pro, Ser, Thr, Val, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RNSFEVRVCXCPXRXWRXEEENL

SEQ ID NO: 28708 - protein, 19 aa, Artificial Sequence
  Description of Artificial Sequence: Synthetic peptide
  Seed: SFEVRVCACPGRDWRTEEE (TP53 R282W)
  Core: ACPGRDWRT
  misc_feature (8)..(8): Xaa can be Ala, Cys, Asp, Glu, Phe, Gly, His, Ile, Lys, Leu, Met, Asn, Pro, Gln, Ser, Thr, Val, Trp, or Tyr
  misc_feature (11)..(11): Xaa can be Ala, Cys, Phe, Gly, His, Ile, Leu, Met, Asn, Ser, Thr, Val, Trp, or Tyr
  misc_feature (13)..(13): Xaa can be Ala, Cys, Asp, Phe, Gly, Ile, Leu, Met, Asn, Pro, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SFEVRVCXCPXRXWRXEEE

SEQ ID NO: 28709 - protein, 20 aa, Artificial Sequence
  Description of Artificial Sequence: Synthetic peptide
  Seed: SFEVRVCACPGRDWRTEEEN (TP53 R282W)
  Core: ACPGRDWRT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Phe, Gly, His, Ile, Leu, Met, Asn, Pro, Gln, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SFEVRVCXCPXRXWRXEEEN

SEQ ID NO: 28710 - protein, 17 aa, Artificial Sequence
  Description of Artificial Sequence: Synthetic peptide
  Seed: DDRNTFRHSVVVPCEPP (TP53 Y220C)
  Core: RHSVVVPCE
  misc_feature (7)..(7): Xaa can be Phe, or Arg
  misc_feature (10)..(10): Xaa can be Ala, Glu, Phe, Ile, Leu, Met, Ser, Thr, or Val
  misc_feature (12)..(12): Xaa can be Phe, Ile, Leu, or Val
  misc_feature (15)..(15): Xaa can be Asp, Glu, Ile, Leu, Met, Asn, Thr, or Val
DDRNTFXHSXVXPCXPP

SEQ ID NO: 28711 - protein, 19 aa, Artificial Sequence
  Description of Artificial Sequence: Synthetic peptide
  Seed: DDRNTFRHSVVVPCEPPEV (TP53 Y220C)
  Core: RHSVVVPCE
  misc_feature (7)..(7): Xaa can be Phe, Leu, Arg, or Tyr
  misc_feature (10)..(10): Xaa can be Ala, Glu, Phe, Ile, Leu, Met, Ser, Thr, Val, or Trp
  misc_feature (12)..(12): Xaa can be Ala, Phe, Ile, Leu, Met, or Val
  misc_feature (15)..(15): Xaa can be Ala, Asp, Glu, Phe, His, Ile, Lys, Leu, Met, Asn, Gln, Arg, Ser, Thr, or Val
DDRNTFXHSXVXPCXPPEV

SEQ ID NO: 28712 - protein, 20 aa, Artificial Sequence
  Description of Artificial Sequence: Synthetic peptide
  Seed: DDRNTFRHSVVVPCEPPEVG (TP53 Y220C)
  Core: RHSVVVPCE
  misc_feature (7)..(7): Xaa can be Ala, Phe, Ile, Lys, Leu, Met, Gln, Arg, Val, Trp, or Tyr
  misc_feature (10)..(10): Xaa can be Ala, Glu, Phe, His, Ile, Leu, Met, Gln, Ser, Thr, Val, Trp, or Tyr
  misc_feature (12)..(12): Xaa can be Ala, Phe, Ile, Leu, Met, Pro, Ser, or Val
  misc_feature (15)..(15): Xaa can be Ala, Cys, Asp, Glu, Gly, His, Ile, Lys, Leu, Met, Asn, Pro, Gln, Arg, Ser, Thr, Val, or Ty r
DDRNTFXHSXVXPCXPPEVG

SEQ ID NO: 28713 - protein, 21 aa, Artificial Sequence
  Description of Artificial Sequence: Synthetic peptide
  Seed: DDRNTFRHSVVVPCEPPEVGS (TP53 Y220C)
  Core: RHSVVVPCE
  misc_feature (7)..(7): Xaa can be , or Arg
  misc_feature (10)..(10): Xaa can be Phe, Ile, Leu, Met, or Val
  misc_feature (12)..(12): Xaa can be Ala, Phe, Ile, Leu, Met, or Val
  misc_feature (15)..(15): Xaa can be Ala, Glu, His, Ile, Lys, Leu, Met, Asn, Gln, Arg, Ser, Thr, or Val
DDRNTFXHSXVXPCXPPEVGS

SEQ ID NO: 28714 - protein, 22 aa, Artificial Sequence
  Description of Artificial Sequence: Synthetic peptide
  Seed: DDRNTFRHSVVVPCEPPEVGSD (TP53 Y220C)
  Core: RHSVVVPCE
  misc_feature (7)..(7): Xaa can be Phe, or Arg
  misc_feature (10)..(10): Xaa can be Phe, Ile, Leu, Met, Thr, or Val
  misc_feature (12)..(12): Xaa can be Ala, Phe, Ile, Leu, Met, or Val
  misc_feature (15)..(15): Xaa can be Ala, Glu, His, Ile, Lys, Leu, Met, Asn, Gln, Arg, Ser, Thr, or Val
DDRNTFXHSXVXPCXPPEVGSD

SEQ ID NO: 28715 - protein, 23 aa, Artificial Sequence
  Description of Artificial Sequence: Synthetic peptide
  Seed: DDRNTFRHSVVVPCEPPEVGSDC (TP53 Y220C)
  Core: RHSVVVPCE
  misc_feature (7)..(7): Xaa can be Phe, or Arg
  misc_feature (10)..(10): Xaa can be Phe, Ile, Leu, Met, Thr, or Val
  misc_feature (12)..(12): Xaa can be Ala, Phe, Ile, Leu, Met, or Val
  misc_feature (15)..(15): Xaa can be Ala, Glu, His, Ile, Lys, Leu, Met, Asn, Gln, Arg, Ser, Thr, or Val
DDRNTFXHSXVXPCXPPEVGSDC

SEQ ID NO: 28716 - protein, 24 aa, Artificial Sequence
  Description of Artificial Sequence: Synthetic peptide
  Seed: DDRNTFRHSVVVPCEPPEVGSDCT (TP53 Y220C)
  Core: RHSVVVPCE
  misc_feature (7)..(7): Xaa can be Phe, or Arg
  misc_feature (10)..(10): Xaa can be Phe, Ile, Leu, Met, Thr, or Val
  misc_feature (12)..(12): Xaa can be Ala, Phe, Ile, Leu, Met, or Val
  misc_feature (15)..(15): Xaa can be Ala, Glu, His, Ile, Lys, Leu, Met, Asn, Gln, Arg, Ser, Thr, or Val
DDRNTFXHSXVXPCXPPEVGSDCT

SEQ ID NO: 28717 - protein, 25 aa, Artificial Sequence
  Description of Artificial Sequence: Synthetic peptide
  Seed: DDRNTFRHSVVVPCEPPEVGSDCTT (TP53 Y220C)
  Core: RHSVVVPCE
  misc_feature (7)..(7): Xaa can be Phe, or Arg
  misc_feature (10)..(10): Xaa can be Phe, Ile, Leu, Met, Thr, or Val
  misc_feature (12)..(12): Xaa can be Ala, Phe, Ile, Leu, Met, or Val
  misc_feature (15)..(15): Xaa can be Ala, Glu, His, Ile, Lys, Leu, Met, Asn, Gln, Arg, Ser, Thr, Val, or Tyr
DDRNTFXHSXVXPCXPPEVGSDCTT

SEQ ID NO: 28718 - protein, 15 aa, Artificial Sequence
  Description of Artificial Sequence: Synthetic peptide
  Seed: DRNTFRHSVVVPCEP (TP53 Y220C)
  Core: RHSVVVPCE
  misc_feature (6)..(6): Xaa can be Phe, Arg, or Tyr
  misc_feature (9)..(9): Xaa can be Ala, Glu, Ile, Leu, Met, Ser, Thr, or Val
  misc_feature (11)..(11): Xaa can be Ala, Phe, Ile, or Leu
  misc_feature (14)..(14): Xaa can be Asp, Glu, Ile, Leu, Met, Asn, Thr, or Val
DRNTFXHSXVXPCXP

SEQ ID NO: 28719 - protein, 16 aa, Artificial Sequence
  Description of Artificial Sequence: Synthetic peptide
  Seed: DRNTFRHSVVVPCEPP (TP53 Y220C)
  Core: RHSVVVPCE
  misc_feature (6)..(6): Xaa can be Phe, or Arg
  misc_feature (9)..(9): Xaa can be Ala, Glu, Phe, Ile, Leu, Met, Ser, Thr, or Val
  misc_feature (11)..(11): Xaa can be Ala, Phe, Ile, Leu, Met, or Val
  misc_feature (14)..(14): Xaa can be Ala, Asp, Glu, His, Ile, Leu, Met, Asn, Gln, Ser, Thr, or Val
DRNTFXHSXVXPCXPP

SEQ ID NO: 28720 - protein, 17 aa, Artificial Sequence
  Description of Artificial Sequence: Synthetic peptide
  Seed: DRNTFRHSVVVPCEPPE (TP53 Y220C)
  Core: RHSVVVPCE
  misc_feature (6)..(6): Xaa can be Phe, Ile, Lys, Leu, Met, Arg, Val, Trp, or Tyr
  misc_feature (9)..(9): Xaa can be Ala, Glu, Phe, His, Ile, Leu, Met, Asn, Gln, Ser, Thr, Val, Trp, or Tyr
  misc_feature (11)..(11): Xaa can be Ala, Cys, Phe, Ile, Leu, Met, Pro, Ser, Thr, or Val
  misc_feature (14)..(14): Xaa can be Ala, Cys, Asp, Glu, Phe, Gly, His, Ile, Lys, Leu, Met, Asn, Gln, Arg, Ser, Thr, Val, or Ty r
DRNTFXHSXVXPCXPPE

SEQ ID NO: 28721 - protein, 19 aa, Artificial Sequence
  Description of Artificial Sequence: Synthetic peptide
  Seed: DRNTFRHSVVVPCEPPEVG (TP53 Y220C)
  Core: RHSVVVPCE
  misc_feature (6)..(6): Xaa can be Phe, Leu, Arg, or Tyr
  misc_feature (9)..(9): Xaa can be Ala, Glu, Phe, Ile, Leu, Met, Ser, Thr, Val, or Trp
  misc_feature (11)..(11): Xaa can be Ala, Phe, Ile, Leu, Met, or Val
  misc_feature (14)..(14): Xaa can be Ala, Asp, Glu, Phe, His, Ile, Lys, Leu, Met, Asn, Gln, Arg, Ser, Thr, or Val
DRNTFXHSXVXPCXPPEVG

SEQ ID NO: 28722 - protein, 20 aa, Artificial Sequence
  Description of Artificial Sequence: Synthetic peptide
  Seed: DRNTFRHSVVVPCEPPEVGS (TP53 Y220C)
  Core: RHSVVVPCE
  misc_feature (6)..(6): Xaa can be Ala, Phe, Ile, Lys, Leu, Met, Gln, Arg, Val, Trp, or Tyr
  misc_feature (9)..(9): Xaa can be Ala, Glu, Phe, His, Ile, Leu, Met, Gln, Ser, Thr, Val, Trp, or Tyr
  misc_feature (11)..(11): Xaa can be Ala, Phe, Ile, Leu, Met, Pro, Ser, or Val
  misc_feature (14)..(14): Xaa can be Ala, Cys, Asp, Glu, Gly, His, Ile, Lys, Leu, Met, Asn, Pro, Gln, Arg, Ser, Thr, Val, or Ty r
DRNTFXHSXVXPCXPPEVGS

SEQ ID NO: 28723 - protein, 21 aa, Artificial Sequence
  Description of Artificial Sequence: Synthetic peptide
  Seed: DRNTFRHSVVVPCEPPEVGSD (TP53 Y220C)
  Core: RHSVVVPCE
  misc_feature (6)..(6): Xaa can be , or Arg
  misc_feature (9)..(9): Xaa can be Phe, Ile, Leu, Met, or Val
  misc_feature (11)..(11): Xaa can be Ala, Phe, Ile, Leu, or Val
  misc_feature (14)..(14): Xaa can be Ala, Glu, His, Ile, Lys, Leu, Met, Asn, Gln, Arg, Ser, Thr, or Val
DRNTFXHSXVXPCXPPEVGSD

SEQ ID NO: 28724 - protein, 22 aa, Artificial Sequence
  Description of Artificial Sequence: Synthetic peptide
  Seed: DRNTFRHSVVVPCEPPEVGSDC (TP53 Y220C)
  Core: RHSVVVPCE
  misc_feature (6)..(6): Xaa can be , or Arg
  misc_feature (9)..(9): Xaa can be Phe, Ile, Leu, Met, or Val
  misc_feature (11)..(11): Xaa can be Ala, Phe, Ile, Leu, Met, or Val
  misc_feature (14)..(14): Xaa can be Ala, Glu, His, Ile, Lys, Leu, Met, Asn, Gln, Arg, Ser, Thr, or Val
DRNTFXHSXVXPCXPPEVGSDC

SEQ ID NO: 28725 - protein, 23 aa, Artificial Sequence
  Description of Artificial Sequence: Synthetic peptide
  Seed: DRNTFRHSVVVPCEPPEVGSDCT (TP53 Y220C)
  Core: RHSVVVPCE
  misc_feature (6)..(6): Xaa can be , or Arg
  misc_feature (9)..(9): Xaa can be Phe, Ile, Leu, Met, or Val
  misc_feature (11)..(11): Xaa can be Ala, Phe, Ile, Leu, Met, or Val
  misc_feature (14)..(14): Xaa can be Ala, Glu, His, Ile, Lys, Leu, Met, Asn, Gln, Arg, Ser, Thr, or Val
DRNTFXHSXVXPCXPPEVGSDCT

SEQ ID NO: 28726 - protein, 24 aa, Artificial Sequence
  Description of Artificial Sequence: Synthetic peptide
  Seed: DRNTFRHSVVVPCEPPEVGSDCTT (TP53 Y220C)
  Core: RHSVVVPCE
  misc_feature (6)..(6): Xaa can be , or Arg
  misc_feature (9)..(9): Xaa can be Phe, Ile, Leu, Met, or Val
  misc_feature (11)..(11): Xaa can be Ala, Phe, Ile, Leu, Met, or Val
  misc_feature (14)..(14): Xaa can be Ala, Glu, His, Ile, Lys, Leu, Met, Asn, Gln, Arg, Ser, Thr, Val, or Tyr
DRNTFXHSXVXPCXPPEVGSDCTT

SEQ ID NO: 28727 - protein, 25 aa, Artificial Sequence
  Description of Artificial Sequence: Synthetic peptide
  Seed: DRNTFRHSVVVPCEPPEVGSDCTTI (TP53 Y220C)
  Core: RHSVVVPCE
  misc_feature (6)..(6): Xaa can be , or Arg
  misc_feature (9)..(9): Xaa can be Phe, Ile, Leu, Met, or Val
  misc_feature (11)..(11): Xaa can be Ala, Phe, Ile, Leu, Met, or Val
  misc_feature (14)..(14): Xaa can be Ala, Glu, His, Ile, Lys, Leu, Met, Asn, Gln, Arg, Ser, Thr, Val, or Tyr
DRNTFXHSXVXPCXPPEVGSDCTTI

SEQ ID NO: 28728 - protein, 20 aa, Artificial Sequence
  Description of Artificial Sequence: Synthetic peptide
  Seed: EYLDDRNTFRHSVVVPCEPP (TP53 Y220C)
  Core: RHSVVVPCE
  misc_feature (10)..(10): Xaa can be Phe, Ile, Leu, Arg, or Tyr
  misc_feature (13)..(13): Xaa can be Ala, Glu, Phe, Ile, Leu, Met, Ser, Thr, or Val
  misc_feature (15)..(15): Xaa can be Ala, Phe, Ile, Leu, or Val
  misc_feature (18)..(18): Xaa can be Asp, Glu, Ile, Leu, Met, Asn, or Val
EYLDDRNTFXHSXVXPCXPP

SEQ ID NO: 28729 - protein, 21 aa, Artificial Sequence
  Description of Artificial Sequence: Synthetic peptide
  Seed: EYLDDRNTFRHSVVVPCEPPE (TP53 Y220C)
  Core: RHSVVVPCE
  misc_feature (10)..(10): Xaa can be Phe, or Arg
  misc_feature (13)..(13): Xaa can be Phe, Ile, Leu, Met, Thr, or Val
  misc_feature (15)..(15): Xaa can be Ala, Phe, Ile, Leu, Met, or Val
  misc_feature (18)..(18): Xaa can be Ala, Glu, His, Ile, Lys, Leu, Met, Asn, Gln, Arg, Ser, Thr, or Val
EYLDDRNTFXHSXVXPCXPPE

SEQ ID NO: 28730 - protein, 22 aa, Artificial Sequence
  Description of Artificial Sequence: Synthetic peptide
  Seed: EYLDDRNTFRHSVVVPCEPPEV (TP53 Y220C)
  Core: RHSVVVPCE
  misc_feature (10)..(10): Xaa can be Phe, or Arg
  misc_feature (13)..(13): Xaa can be Phe, Ile, Leu, Met, Thr, Val, or Trp
  misc_feature (15)..(15): Xaa can be Ala, Phe, Ile, Leu, Met, or Val
  misc_feature (18)..(18): Xaa can be Ala, Asp, Glu, His, Ile, Lys, Leu, Met, Asn, Gln, Arg, Ser, Thr, or Val
EYLDDRNTFXHSXVXPCXPPEV

SEQ ID NO: 28731 - protein, 23 aa, Artificial Sequence
  Description of Artificial Sequence: Synthetic peptide
  Seed: EYLDDRNTFRHSVVVPCEPPEVG (TP53 Y220C)
  Core: RHSVVVPCE
  misc_feature (10)..(10): Xaa can be Phe, or Arg
  misc_feature (13)..(13): Xaa can be Phe, Ile, Leu, Met, Ser, Thr, Val, or Trp
  misc_feature (15)..(15): Xaa can be Ala, Phe, Ile, Leu, Met, or Val
  misc_feature (18)..(18): Xaa can be Ala, Asp, Glu, His, Ile, Lys, Leu, Met, Asn, Gln, Arg, Ser, Thr, or Val
EYLDDRNTFXHSXVXPCXPPEVG

SEQ ID NO: 28732 - protein, 24 aa, Artificial Sequence
  Description of Artificial Sequence: Synthetic peptide
  Seed: EYLDDRNTFRHSVVVPCEPPEVGS (TP53 Y220C)
  Core: RHSVVVPCE
  misc_feature (10)..(10): Xaa can be Phe, Leu, or Arg
  misc_feature (13)..(13): Xaa can be Phe, Ile, Leu, Met, Ser, Thr, Val, or Trp
  misc_feature (15)..(15): Xaa can be Ala, Phe, Ile, Leu, Met, or Val
  misc_feature (18)..(18): Xaa can be Ala, Asp, Glu, His, Ile, Lys, Leu, Met, Asn, Gln, Arg, Ser, Thr, or Val
EYLDDRNTFXHSXVXPCXPPEVGS

SEQ ID NO: 28733 - protein, 25 aa, Artificial Sequence
  Description of Artificial Sequence: Synthetic peptide
  Seed: EYLDDRNTFRHSVVVPCEPPEVGSD (TP53 Y220C)
  Core: RHSVVVPCE
  misc_feature (10)..(10): Xaa can be Phe, Leu, or Arg
  misc_feature (13)..(13): Xaa can be Ala, Phe, Ile, Leu, Met, Ser, Thr, Val, or Trp
  misc_feature (15)..(15): Xaa can be Ala, Phe, Ile, Leu, Met, or Val
  misc_feature (18)..(18): Xaa can be Ala, Asp, Glu, His, Ile, Lys, Leu, Met, Asn, Gln, Arg, Ser, Thr, or Val
EYLDDRNTFXHSXVXPCXPPEVGSD

SEQ ID NO: 28734 - protein, 14 aa, Artificial Sequence
  Description of Artificial Sequence: Synthetic peptide
  Seed: FRHSVVVPCEPPEV (TP53 Y220C)
  Core: RHSVVVPCE
  misc_feature (2)..(2): Xaa can be Ala, Cys, Glu, Phe, His, Ile, Lys, Leu, Met, Gln, Arg, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, His, Ile, Leu, Met, Asn, Pro, Gln, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
FXHSXVXPCXPPEV

SEQ ID NO: 28735 - protein, 15 aa, Artificial Sequence
  Description of Artificial Sequence: Synthetic peptide
  Seed: FRHSVVVPCEPPEVG (TP53 Y220C)
  Core: RHSVVVPCE
  misc_feature (2)..(2): Xaa can be Phe, Ile, or Arg
  misc_feature (5)..(5): Xaa can be Ala, Phe, Ile, Leu, Met, Ser, Thr, or Val
  misc_feature (7)..(7): Xaa can be Ala, Ile, Leu, Met, or Val
  misc_feature (10)..(10): Xaa can be Ala, Glu, Phe, His, Ile, Leu, Met, Asn, Gln, Ser, Thr, Val, or Tyr
FXHSXVXPCXPPEVG

SEQ ID NO: 28736 - protein, 16 aa, Artificial Sequence
  Description of Artificial Sequence: Synthetic peptide
  Seed: FRHSVVVPCEPPEVGS (TP53 Y220C)
  Core: RHSVVVPCE
  misc_feature (2)..(2): Xaa can be Phe, or Arg
  misc_feature (5)..(5): Xaa can be Ala, Phe, Ile, Leu, Met, or Val
  misc_feature (7)..(7): Xaa can be Ala, Ile, Leu, or Val
  misc_feature (10)..(10): Xaa can be Ala, Glu, Phe, His, Ile, Leu, Met, Asn, Gln, Ser, Thr, Val, or Tyr
FXHSXVXPCXPPEVGS

SEQ ID NO: 28737 - protein, 25 aa, Artificial Sequence
  Description of Artificial Sequence: Synthetic peptide
  Seed: GNLRVEYLDDRNTFRHSVVVPCEPP (TP53 Y220C)
  Core: RHSVVVPCE
  misc_feature (15)..(15): Xaa can be Phe, or Arg
  misc_feature (18)..(18): Xaa can be Ile, or Thr
  misc_feature (20)..(20): Xaa can be Phe, or Ile
  misc_feature (23)..(23): Xaa can be Ile, Leu, or Val
GNLRVEYLDDRNTFXHSXVXPCXPP

SEQ ID NO: 28738 - protein, 19 aa, Artificial Sequence
  Description of Artificial Sequence: Synthetic peptide
  Seed: LDDRNTFRHSVVVPCEPPE (TP53 Y220C)
  Core: RHSVVVPCE
  misc_feature (8)..(8): Xaa can be Phe, Leu, Arg, or Tyr
  misc_feature (11)..(11): Xaa can be Ala, Glu, Phe, Ile, Leu, Met, Ser, Thr, Val, or Trp
  misc_feature (13)..(13): Xaa can be Ala, Phe, Ile, Leu, Met, or Val
  misc_feature (16)..(16): Xaa can be Ala, Asp, Glu, Phe, His, Ile, Lys, Leu, Met, Asn, Gln, Arg, Ser, Thr, or Val
LDDRNTFXHSXVXPCXPPE

SEQ ID NO: 28739 - protein, 20 aa, Artificial Sequence
  Description of Artificial Sequence: Synthetic peptide
  Seed: LDDRNTFRHSVVVPCEPPEV (TP53 Y220C)
  Core: RHSVVVPCE
  misc_feature (8)..(8): Xaa can be Ala, Phe, Ile, Lys, Leu, Met, Gln, Arg, Val, Trp, or Tyr
  misc_feature (11)..(11): Xaa can be Ala, Glu, Phe, His, Ile, Leu, Met, Gln, Ser, Thr, Val, Trp, or Tyr
  misc_feature (13)..(13): Xaa can be Ala, Phe, Ile, Leu, Met, Pro, Ser, or Val
  misc_feature (16)..(16): Xaa can be Ala, Cys, Asp, Glu, Gly, His, Ile, Lys, Leu, Met, Asn, Pro, Gln, Arg, Ser, Thr, Val, or Ty r
LDDRNTFXHSXVXPCXPPEV

SEQ ID NO: 28740 - protein, 21 aa, Artificial Sequence
  Description of Artificial Sequence: Synthetic peptide
  Seed: LDDRNTFRHSVVVPCEPPEVG (TP53 Y220C)
  Core: RHSVVVPCE
  misc_feature (8)..(8): Xaa can be Phe, or Arg
  misc_feature (11)..(11): Xaa can be Phe, Ile, Leu, Met, Thr, or Val
  misc_feature (13)..(13): Xaa can be Ala, Phe, Ile, Leu, Met, or Val
  misc_feature (16)..(16): Xaa can be Ala, Glu, His, Ile, Lys, Leu, Met, Asn, Gln, Arg, Ser, Thr, or Val
LDDRNTFXHSXVXPCXPPEVG

SEQ ID NO: 28741 - protein, 22 aa, Artificial Sequence
  Description of Artificial Sequence: Synthetic peptide
  Seed: LDDRNTFRHSVVVPCEPPEVGS (TP53 Y220C)
  Core: RHSVVVPCE
  misc_feature (8)..(8): Xaa can be Phe, or Arg
  misc_feature (11)..(11): Xaa can be Phe, Ile, Leu, Met, Thr, or Val
  misc_feature (13)..(13): Xaa can be Ala, Phe, Ile, Leu, Met, or Val
  misc_feature (16)..(16): Xaa can be Ala, Glu, His, Ile, Lys, Leu, Met, Asn, Gln, Arg, Ser, Thr, or Val
LDDRNTFXHSXVXPCXPPEVGS

SEQ ID NO: 28742 - protein, 23 aa, Artificial Sequence
  Description of Artificial Sequence: Synthetic peptide
  Seed: LDDRNTFRHSVVVPCEPPEVGSD (TP53 Y220C)
  Core: RHSVVVPCE
  misc_feature (8)..(8): Xaa can be Phe, or Arg
  misc_feature (11)..(11): Xaa can be Phe, Ile, Leu, Met, Thr, or Val
  misc_feature (13)..(13): Xaa can be Ala, Phe, Ile, Leu, Met, or Val
  misc_feature (16)..(16): Xaa can be Ala, Glu, His, Ile, Lys, Leu, Met, Asn, Gln, Arg, Ser, Thr, or Val
LDDRNTFXHSXVXPCXPPEVGSD

SEQ ID NO: 28743 - protein, 24 aa, Artificial Sequence
  Description of Artificial Sequence: Synthetic peptide
  Seed: LDDRNTFRHSVVVPCEPPEVGSDC (TP53 Y220C)
  Core: RHSVVVPCE
  misc_feature (8)..(8): Xaa can be Phe, or Arg
  misc_feature (11)..(11): Xaa can be Phe, Ile, Leu, Met, Thr, Val, or Trp
  misc_feature (13)..(13): Xaa can be Ala, Phe, Ile, Leu, Met, or Val
  misc_feature (16)..(16): Xaa can be Ala, Asp, Glu, His, Ile, Lys, Leu, Met, Asn, Gln, Arg, Ser, Thr, or Val
LDDRNTFXHSXVXPCXPPEVGSDC

SEQ ID NO: 28744 - protein, 25 aa, Artificial Sequence
  Description of Artificial Sequence: Synthetic peptide
  Seed: LDDRNTFRHSVVVPCEPPEVGSDCT (TP53 Y220C)
  Core: RHSVVVPCE
  misc_feature (8)..(8): Xaa can be Phe, or Arg
  misc_feature (11)..(11): Xaa can be Phe, Ile, Leu, Met, Thr, Val, or Trp
  misc_feature (13)..(13): Xaa can be Ala, Phe, Ile, Leu, Met, or Val
  misc_feature (16)..(16): Xaa can be Ala, Asp, Glu, His, Ile, Lys, Leu, Met, Asn, Gln, Arg, Ser, Thr, Val, or Tyr
LDDRNTFXHSXVXPCXPPEVGSDCT

SEQ ID NO: 28745 - protein, 24 aa, Artificial Sequence
  Description of Artificial Sequence: Synthetic peptide
  Seed: LRVEYLDDRNTFRHSVVVPCEPPE (TP53 Y220C)
  Core: RHSVVVPCE
  misc_feature (13)..(13): Xaa can be Phe, or Arg
  misc_feature (16)..(16): Xaa can be Ala, Phe, Ile, Leu, Met, Ser, Thr, or Val
  misc_feature (18)..(18): Xaa can be Ala, Phe, Ile, Leu, Met, or Val
  misc_feature (21)..(21): Xaa can be Ala, Asp, Glu, His, Ile, Lys, Leu, Met, Asn, Gln, Arg, Ser, Thr, or Val
LRVEYLDDRNTFXHSXVXPCXPPE

SEQ ID NO: 28746 - protein, 25 aa, Artificial Sequence
  Description of Artificial Sequence: Synthetic peptide
  Seed: LRVEYLDDRNTFRHSVVVPCEPPEV (TP53 Y220C)
  Core: RHSVVVPCE
  misc_feature (13)..(13): Xaa can be Phe, Leu, or Arg
  misc_feature (16)..(16): Xaa can be Ala, Phe, Ile, Leu, Met, Ser, Thr, Val, or Trp
  misc_feature (18)..(18): Xaa can be Ala, Phe, Ile, Leu, Met, or Val
  misc_feature (21)..(21): Xaa can be Ala, Asp, Glu, His, Ile, Lys, Leu, Met, Asn, Gln, Arg, Ser, Thr, or Val
LRVEYLDDRNTFXHSXVXPCXPPEV

SEQ ID NO: 28747 - protein, 25 aa, Artificial Sequence
  Description of Artificial Sequence: Synthetic peptide
  Seed: NLRVEYLDDRNTFRHSVVVPCEPPE (TP53 Y220C)
  Core: RHSVVVPCE
  misc_feature (14)..(14): Xaa can be Phe, or Arg
  misc_feature (17)..(17): Xaa can be Ala, Phe, Ile, Leu, Met, Ser, Thr, or Val
  misc_feature (19)..(19): Xaa can be Ala, Phe, Ile, Leu, Met, or Val
  misc_feature (22)..(22): Xaa can be Ala, Asp, Glu, His, Ile, Lys, Leu, Met, Asn, Gln, Arg, Ser, Thr, or Val
NLRVEYLDDRNTFXHSXVXPCXPPE

SEQ ID NO: 28748 - protein, 13 aa, Artificial Sequence
  Description of Artificial Sequence: Synthetic peptide
  Seed: NTFRHSVVVPCEP (TP53 Y220C)
  Core: RHSVVVPCE
  misc_feature (4)..(4): Xaa can be , or Arg
  misc_feature (7)..(7): Xaa can be Ile, Leu, Met, or Val
  misc_feature (9)..(9): Xaa can be Ala, Ile, or Val
  misc_feature (12)..(12): Xaa can be Ala, His, Met, Asn, Gln, Ser, Thr, or Val
NTFXHSXVXPCXP

SEQ ID NO: 28749 - protein, 14 aa, Artificial Sequence
  Description of Artificial Sequence: Synthetic peptide
  Seed: NTFRHSVVVPCEPP (TP53 Y220C)
  Core: RHSVVVPCE
  misc_feature (4)..(4): Xaa can be Phe, Ile, Lys, or Arg
  misc_feature (7)..(7): Xaa can be Ala, Phe, Ile, Leu, Met, Ser, Thr, Val, or Trp
  misc_feature (9)..(9): Xaa can be Ala, Phe, Ile, Leu, Met, Pro, or Val
  misc_feature (12)..(12): Xaa can be Ala, Cys, Asp, Glu, Gly, His, Ile, Lys, Leu, Met, Asn, Gln, Arg, Ser, Thr, Val, or Tyr
NTFXHSXVXPCXPP

SEQ ID NO: 28750 - protein, 15 aa, Artificial Sequence
  Description of Artificial Sequence: Synthetic peptide
  Seed: NTFRHSVVVPCEPPE (TP53 Y220C)
  Core: RHSVVVPCE
  misc_feature (4)..(4): Xaa can be Ala, Phe, Ile, Lys, Leu, Met, Gln, Arg, Val, Trp, or Tyr
  misc_feature (7)..(7): Xaa can be Ala, Glu, Phe, His, Ile, Leu, Met, Gln, Ser, Thr, Val, Trp, or Tyr
  misc_feature (9)..(9): Xaa can be Ala, Cys, Phe, Ile, Leu, Met, Pro, Ser, Thr, Val, or Tyr
  misc_feature (12)..(12): Xaa can be Ala, Cys, Asp, Glu, Phe, Gly, His, Ile, Lys, Leu, Met, Asn, Gln, Arg, Ser, Thr, Val, or Ty r
NTFXHSXVXPCXPPE

SEQ ID NO: 28751 - protein, 16 aa, Artificial Sequence
  Description of Artificial Sequence: Synthetic peptide
  Seed: NTFRHSVVVPCEPPEV (TP53 Y220C)
  Core: RHSVVVPCE
  misc_feature (4)..(4): Xaa can be Ala, Cys, Glu, Phe, Ile, Lys, Leu, Met, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Phe, Ile, Lys, Leu, Met, Pro, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTFXHSXVXPCXPPEV

SEQ ID NO: 28752 - protein, 17 aa, Artificial Sequence
  Description of Artificial Sequence: Synthetic peptide
  Seed: NTFRHSVVVPCEPPEVG (TP53 Y220C)
  Core: RHSVVVPCE
  misc_feature (4)..(4): Xaa can be Ala, Glu, Phe, Ile, Lys, Leu, Met, Gln, Arg, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Phe, Ile, Lys, Leu, Met, Pro, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
NTFXHSXVXPCXPPEVG

SEQ ID NO: 28753 - protein, 18 aa, Artificial Sequence
  Description of Artificial Sequence: Synthetic peptide
  Seed: NTFRHSVVVPCEPPEVGS (TP53 Y220C)
  Core: RHSVVVPCE
  misc_feature (4)..(4): Xaa can be , or Arg
  misc_feature (7)..(7): Xaa can be Ile, Leu, or Val
  misc_feature (9)..(9): Xaa can be Ala, or Ile
  misc_feature (12)..(12): Xaa can be Ala, Ile, Leu, Met, Asn, Ser, or Val
NTFXHSXVXPCXPPEVGS

SEQ ID NO: 28754 - protein, 19 aa, Artificial Sequence
  Description of Artificial Sequence: Synthetic peptide
  Seed: NTFRHSVVVPCEPPEVGSD (TP53 Y220C)
  Core: RHSVVVPCE
  misc_feature (4)..(4): Xaa can be Phe, Ile, Leu, Met, Arg, Val, or Tyr
  misc_feature (7)..(7): Xaa can be Ala, Phe, Ile, Leu, Met, Ser, Thr, Val, Trp, or Tyr
  misc_feature (9)..(9): Xaa can be Ala, Ile, Leu, Met, Pro, or Val
  misc_feature (12)..(12): Xaa can be Ala, Asp, Glu, Gly, His, Ile, Lys, Leu, Met, Asn, Gln, Arg, Ser, Thr, or Val
NTFXHSXVXPCXPPEVGSD

SEQ ID NO: 28755 - protein, 20 aa, Artificial Sequence
  Description of Artificial Sequence: Synthetic peptide
  Seed: NTFRHSVVVPCEPPEVGSDC (TP53 Y220C)
  Core: RHSVVVPCE
  misc_feature (4)..(4): Xaa can be Ala, Glu, Phe, Ile, Lys, Leu, Met, Gln, Arg, Thr, Val, Trp, or Tyr
  misc_feature (7)..(7): Xaa can be Ala, Cys, Glu, Phe, Gly, His, Ile, Leu, Met, Asn, Gln, Ser, Thr, Val, Trp, or Tyr
  misc_feature (9)..(9): Xaa can be Ala, Cys, Phe, Ile, Leu, Met, Asn, Pro, Ser, Thr, or Val
  misc_feature (12)..(12): Xaa can be Ala, Cys, Asp, Glu, Phe, Gly, His, Ile, Lys, Leu, Met, Asn, Pro, Gln, Arg, Ser, Thr, Val, or Tyr
NTFXHSXVXPCXPPEVGSDC

SEQ ID NO: 28756 - protein, 21 aa, Artificial Sequence
  Description of Artificial Sequence: Synthetic peptide
  Seed: NTFRHSVVVPCEPPEVGSDCT (TP53 Y220C)
  Core: RHSVVVPCE
  misc_feature (4)..(4): Xaa can be Phe, or Arg
  misc_feature (7)..(7): Xaa can be Ala, Phe, Ile, Leu, Met, Ser, Thr, Val, or Trp
  misc_feature (9)..(9): Xaa can be Ala, Ile, Leu, or Val
  misc_feature (12)..(12): Xaa can be Ala, Asp, His, Ile, Leu, Met, Asn, Ser, Thr, or Val
NTFXHSXVXPCXPPEVGSDCT

SEQ ID NO: 28757 - protein, 22 aa, Artificial Sequence
  Description of Artificial Sequence: Synthetic peptide
  Seed: NTFRHSVVVPCEPPEVGSDCTT (TP53 Y220C)
  Core: RHSVVVPCE
  misc_feature (4)..(4): Xaa can be Phe, or Arg
  misc_feature (7)..(7): Xaa can be Ala, Phe, Ile, Leu, Met, Ser, Thr, Val, or Trp
  misc_feature (9)..(9): Xaa can be Ala, Ile, Leu, or Val
  misc_feature (12)..(12): Xaa can be Ala, Asp, His, Ile, Leu, Met, Asn, Ser, Thr, or Val
NTFXHSXVXPCXPPEVGSDCTT

SEQ ID NO: 28758 - protein, 23 aa, Artificial Sequence
  Description of Artificial Sequence: Synthetic peptide
  Seed: NTFRHSVVVPCEPPEVGSDCTTI (TP53 Y220C)
  Core: RHSVVVPCE
  misc_feature (4)..(4): Xaa can be Phe, or Arg
  misc_feature (7)..(7): Xaa can be Ala, Phe, Ile, Leu, Met, Ser, Thr, Val, or Trp
  misc_feature (9)..(9): Xaa can be Ala, Ile, Leu, or Val
  misc_feature (12)..(12): Xaa can be Ala, Asp, His, Ile, Leu, Met, Asn, Ser, Thr, or Val
NTFXHSXVXPCXPPEVGSDCTTI

SEQ ID NO: 28759 - protein, 24 aa, Artificial Sequence
  Description of Artificial Sequence: Synthetic peptide
  Seed: NTFRHSVVVPCEPPEVGSDCTTIH (TP53 Y220C)
  Core: RHSVVVPCE
  misc_feature (4)..(4): Xaa can be Phe, or Arg
  misc_feature (7)..(7): Xaa can be Ala, Phe, Ile, Leu, Met, Ser, Thr, Val, or Trp
  misc_feature (9)..(9): Xaa can be Ala, Ile, Leu, Met, or Val
  misc_feature (12)..(12): Xaa can be Ala, Asp, Glu, His, Ile, Leu, Met, Asn, Gln, Arg, Ser, Thr, or Val
NTFXHSXVXPCXPPEVGSDCTTIH

SEQ ID NO: 28760 - protein, 25 aa, Artificial Sequence
  Description of Artificial Sequence: Synthetic peptide
  Seed: NTFRHSVVVPCEPPEVGSDCTTIHY (TP53 Y220C)
  Core: RHSVVVPCE
  misc_feature (4)..(4): Xaa can be Phe, Arg, or Tyr
  misc_feature (7)..(7): Xaa can be Ala, Phe, Ile, Leu, Met, Ser, Thr, Val, or Trp
  misc_feature (9)..(9): Xaa can be Ala, Ile, Leu, Met, Pro, or Val
  misc_feature (12)..(12): Xaa can be Ala, Asp, Glu, His, Ile, Leu, Met, Asn, Gln, Arg, Ser, Thr, or Val
NTFXHSXVXPCXPPEVGSDCTTIHY

SEQ ID NO: 28761 - protein, 15 aa, Artificial Sequence
  Description of Artificial Sequence: Synthetic peptide
  Seed: RNTFRHSVVVPCEPP (TP53 Y220C)
  Core: RHSVVVPCE
  misc_feature (5)..(5): Xaa can be Phe, Ile, Leu, Met, Arg, Val, or Tyr
  misc_feature (8)..(8): Xaa can be Ala, Glu, Phe, Ile, Leu, Met, Gln, Ser, Thr, Val, or Trp
  misc_feature (10)..(10): Xaa can be Ala, Phe, Ile, Leu, Met, Pro, or Val
  misc_feature (13)..(13): Xaa can be Ala, Cys, Asp, Glu, Phe, Gly, His, Ile, Lys, Leu, Met, Asn, Gln, Arg, Ser, Thr, or Val
RNTFXHSXVXPCXPP

SEQ ID NO: 28762 - protein, 16 aa, Artificial Sequence
  Description of Artificial Sequence: Synthetic peptide
  Seed: RNTFRHSVVVPCEPPE (TP53 Y220C)
  Core: RHSVVVPCE
  misc_feature (5)..(5): Xaa can be Ala, Cys, Phe, Ile, Lys, Leu, Met, Gln, Arg, Val, Trp, or Tyr
  misc_feature (8)..(8): Xaa can be Ala, Cys, Asp, Glu, Phe, Gly, His, Ile, Lys, Leu, Met, Asn, Gln, Ser, Thr, Val, Trp, or Ty r
  misc_feature (10)..(10): Xaa can be Ala, Cys, Phe, Gly, Ile, Leu, Met, Pro, Ser, Thr, Val, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, Trp, or Tyr
RNTFXHSXVXPCXPPE

SEQ ID NO: 28763 - protein, 17 aa, Artificial Sequence
  Description of Artificial Sequence: Synthetic peptide
  Seed: RNTFRHSVVVPCEPPEV (TP53 Y220C)
  Core: RHSVVVPCE
  misc_feature (5)..(5): Xaa can be Ala, Phe, Ile, Lys, Leu, Met, Gln, Arg, Thr, Val, Trp, or Tyr
  misc_feature (8)..(8): Xaa can be Ala, Glu, Phe, Gly, His, Ile, Leu, Met, Asn, Gln, Ser, Thr, Val, Trp, or Tyr
  misc_feature (10)..(10): Xaa can be Ala, Cys, Phe, Ile, Leu, Met, Pro, Ser, Thr, Val, or Tyr
  misc_feature (13)..(13): Xaa can be Ala, Cys, Asp, Glu, Phe, Gly, His, Ile, Lys, Leu, Met, Asn, Gln, Arg, Ser, Thr, Val, or Ty r
RNTFXHSXVXPCXPPEV

SEQ ID NO: 28764 - protein, 19 aa, Artificial Sequence
  Description of Artificial Sequence: Synthetic peptide
  Seed: RNTFRHSVVVPCEPPEVGS (TP53 Y220C)
  Core: RHSVVVPCE
  misc_feature (5)..(5): Xaa can be Phe, Arg, or Tyr
  misc_feature (8)..(8): Xaa can be Ala, Phe, Ile, Leu, Met, Ser, Thr, Val, or Trp
  misc_feature (10)..(10): Xaa can be Ala, Phe, Ile, Leu, Met, or Val
  misc_feature (13)..(13): Xaa can be Ala, Asp, Glu, Phe, His, Ile, Lys, Leu, Met, Asn, Gln, Arg, Ser, Thr, Val, or Tyr
RNTFXHSXVXPCXPPEVGS

SEQ ID NO: 28765 - protein, 20 aa, Artificial Sequence
  Description of Artificial Sequence: Synthetic peptide
  Seed: RNTFRHSVVVPCEPPEVGSD (TP53 Y220C)
  Core: RHSVVVPCE
  misc_feature (5)..(5): Xaa can be Phe, Ile, Lys, Leu, Met, Gln, Arg, Val, or Tyr
  misc_feature (8)..(8): Xaa can be Ala, Glu, Phe, His, Ile, Leu, Met, Gln, Ser, Thr, Val, Trp, or Tyr
  misc_feature (10)..(10): Xaa can be Ala, Phe, Ile, Leu, Met, Pro, Ser, or Val
  misc_feature (13)..(13): Xaa can be Ala, Cys, Asp, Glu, Gly, His, Ile, Lys, Leu, Met, Asn, Pro, Gln, Arg, Ser, Thr, Val, or Ty r
RNTFXHSXVXPCXPPEVGSD

SEQ ID NO: 28766 - protein, 22 aa, Artificial Sequence
  Description of Artificial Sequence: Synthetic peptide
  Seed: RNTFRHSVVVPCEPPEVGSDCT (TP53 Y220C)
  Core: RHSVVVPCE
  misc_feature (5)..(5): Xaa can be , or Arg
  misc_feature (8)..(8): Xaa can be Phe, Ile, Leu, Met, or Val
  misc_feature (10)..(10): Xaa can be Ala, Ile, Leu, or Val
  misc_feature (13)..(13): Xaa can be Ala, Glu, His, Ile, Lys, Leu, Met, Asn, Gln, Arg, Ser, Thr, or Val
RNTFXHSXVXPCXPPEVGSDCT

SEQ ID NO: 28767 - protein, 23 aa, Artificial Sequence
  Description of Artificial Sequence: Synthetic peptide
  Seed: RNTFRHSVVVPCEPPEVGSDCTT (TP53 Y220C)
  Core: RHSVVVPCE
  misc_feature (5)..(5): Xaa can be , or Arg
  misc_feature (8)..(8): Xaa can be Phe, Ile, Leu, Met, or Val
  misc_feature (10)..(10): Xaa can be Ala, Ile, Leu, or Val
  misc_feature (13)..(13): Xaa can be Ala, Glu, His, Ile, Lys, Leu, Met, Asn, Gln, Arg, Ser, Thr, Val, or Tyr
RNTFXHSXVXPCXPPEVGSDCTT

SEQ ID NO: 28768 - protein, 24 aa, Artificial Sequence
  Description of Artificial Sequence: Synthetic peptide
  Seed: RNTFRHSVVVPCEPPEVGSDCTTI (TP53 Y220C)
  Core: RHSVVVPCE
  misc_feature (5)..(5): Xaa can be , or Arg
  misc_feature (8)..(8): Xaa can be Phe, Ile, Leu, Met, or Val
  misc_feature (10)..(10): Xaa can be Ala, Ile, Leu, or Val
  misc_feature (13)..(13): Xaa can be Ala, Glu, His, Ile, Lys, Leu, Met, Asn, Gln, Arg, Ser, Thr, Val, or Tyr
RNTFXHSXVXPCXPPEVGSDCTTI

SEQ ID NO: 28769 - protein, 25 aa, Artificial Sequence
  Description of Artificial Sequence: Synthetic peptide
  Seed: RNTFRHSVVVPCEPPEVGSDCTTIH (TP53 Y220C)
  Core: RHSVVVPCE
  misc_feature (5)..(5): Xaa can be , or Arg
  misc_feature (8)..(8): Xaa can be Phe, Ile, Leu, Met, or Val
  misc_feature (10)..(10): Xaa can be Ala, Ile, Leu, or Val
  misc_feature (13)..(13): Xaa can be Ala, Glu, His, Ile, Lys, Leu, Met, Asn, Gln, Arg, Ser, Thr, Val, or Tyr
RNTFXHSXVXPCXPPEVGSDCTTIH

SEQ ID NO: 28770 - protein, 23 aa, Artificial Sequence
  Description of Artificial Sequence: Synthetic peptide
  Seed: RVEYLDDRNTFRHSVVVPCEPPE (TP53 Y220C)
  Core: RHSVVVPCE
  misc_feature (12)..(12): Xaa can be Phe, or Arg
  misc_feature (15)..(15): Xaa can be Phe, Ile, Leu, Met, Ser, Thr, or Val
  misc_feature (17)..(17): Xaa can be Ala, Phe, Ile, Leu, Met, or Val
  misc_feature (20)..(20): Xaa can be Ala, Asp, Glu, His, Ile, Lys, Leu, Met, Asn, Gln, Arg, Ser, Thr, or Val
RVEYLDDRNTFXHSXVXPCXPPE

SEQ ID NO: 28771 - protein, 24 aa, Artificial Sequence
  Description of Artificial Sequence: Synthetic peptide
  Seed: RVEYLDDRNTFRHSVVVPCEPPEV (TP53 Y220C)
  Core: RHSVVVPCE
  misc_feature (12)..(12): Xaa can be Phe, Leu, or Arg
  misc_feature (15)..(15): Xaa can be Ala, Phe, Ile, Leu, Met, Ser, Thr, Val, or Trp
  misc_feature (17)..(17): Xaa can be Ala, Phe, Ile, Leu, Met, or Val
  misc_feature (20)..(20): Xaa can be Ala, Asp, Glu, His, Ile, Lys, Leu, Met, Asn, Gln, Arg, Ser, Thr, or Val
RVEYLDDRNTFXHSXVXPCXPPEV

SEQ ID NO: 28772 - protein, 25 aa, Artificial Sequence
  Description of Artificial Sequence: Synthetic peptide
  Seed: RVEYLDDRNTFRHSVVVPCEPPEVG (TP53 Y220C)
  Core: RHSVVVPCE
  misc_feature (12)..(12): Xaa can be Phe, Leu, or Arg
  misc_feature (15)..(15): Xaa can be Ala, Phe, Ile, Leu, Met, Ser, Thr, Val, or Trp
  misc_feature (17)..(17): Xaa can be Ala, Phe, Ile, Leu, Met, or Val
  misc_feature (20)..(20): Xaa can be Ala, Asp, Glu, His, Ile, Lys, Leu, Met, Asn, Gln, Arg, Ser, Thr, or Val
RVEYLDDRNTFXHSXVXPCXPPEVG

SEQ ID NO: 28773 - protein, 13 aa, Artificial Sequence
  Description of Artificial Sequence: Synthetic peptide
  Seed: TFRHSVVVPCEPP (TP53 Y220C)
  Core: RHSVVVPCE
  misc_feature (3)..(3): Xaa can be , or Arg
  misc_feature (6)..(6): Xaa can be Ile, Leu, Met, or Val
  misc_feature (8)..(8): Xaa can be Ala, or Ile
  misc_feature (11)..(11): Xaa can be Ala, His, Ile, Leu, Met, Asn, Ser, Thr, or Val
TFXHSXVXPCXPP

SEQ ID NO: 28774 - protein, 14 aa, Artificial Sequence
  Description of Artificial Sequence: Synthetic peptide
  Seed: TFRHSVVVPCEPPE (TP53 Y220C)
  Core: RHSVVVPCE
  misc_feature (3)..(3): Xaa can be Ala, Phe, Ile, Lys, Leu, Met, Gln, Arg, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Phe, Ile, Leu, Met, Pro, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TFXHSXVXPCXPPE

SEQ ID NO: 28775 - protein, 15 aa, Artificial Sequence
  Description of Artificial Sequence: Synthetic peptide
  Seed: TFRHSVVVPCEPPEV (TP53 Y220C)
  Core: RHSVVVPCE
  misc_feature (3)..(3): Xaa can be Ala, Cys, Glu, Phe, Ile, Lys, Leu, Met, Asn, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Glu, Phe, His, Ile, Lys, Leu, Met, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TFXHSXVXPCXPPEV

SEQ ID NO: 28776 - protein, 16 aa, Artificial Sequence
  Description of Artificial Sequence: Synthetic peptide
  Seed: TFRHSVVVPCEPPEVG (TP53 Y220C)
  Core: RHSVVVPCE
  misc_feature (3)..(3): Xaa can be Ala, Glu, Phe, Ile, Lys, Leu, Met, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Phe, His, Ile, Leu, Met, Pro, Gln, Ser, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TFXHSXVXPCXPPEVG

SEQ ID NO: 28777 - protein, 17 aa, Artificial Sequence
  Description of Artificial Sequence: Synthetic peptide
  Seed: TFRHSVVVPCEPPEVGS (TP53 Y220C)
  Core: RHSVVVPCE
  misc_feature (3)..(3): Xaa can be Ala, Glu, Phe, Ile, Lys, Leu, Met, Gln, Arg, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Phe, Ile, Leu, Met, Pro, Gln, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TFXHSXVXPCXPPEVGS

SEQ ID NO: 28778 - protein, 19 aa, Artificial Sequence
  Description of Artificial Sequence: Synthetic peptide
  Seed: TFRHSVVVPCEPPEVGSDC (TP53 Y220C)
  Core: RHSVVVPCE
  misc_feature (3)..(3): Xaa can be Phe, or Arg
  misc_feature (6)..(6): Xaa can be Ala, Phe, Ile, Leu, Met, Ser, Thr, or Val
  misc_feature (8)..(8): Xaa can be Ala, Ile, Leu, Met, or Val
  misc_feature (11)..(11): Xaa can be Ala, Asp, Glu, His, Ile, Lys, Leu, Met, Asn, Gln, Arg, Ser, Thr, or Val
TFXHSXVXPCXPPEVGSDC

SEQ ID NO: 28779 - protein, 20 aa, Artificial Sequence
  Description of Artificial Sequence: Synthetic peptide
  Seed: TFRHSVVVPCEPPEVGSDCT (TP53 Y220C)
  Core: RHSVVVPCE
  misc_feature (3)..(3): Xaa can be Phe, Ile, Lys, Leu, Met, Arg, Val, Trp, or Tyr
  misc_feature (6)..(6): Xaa can be Ala, Cys, Glu, Phe, Ile, Leu, Met, Gln, Ser, Thr, Val, Trp, or Tyr
  misc_feature (8)..(8): Xaa can be Ala, Phe, Ile, Leu, Met, Pro, Ser, Thr, or Val
  misc_feature (11)..(11): Xaa can be Ala, Asp, Glu, Phe, Gly, His, Ile, Lys, Leu, Met, Asn, Gln, Arg, Ser, Thr, Val, or Tyr
TFXHSXVXPCXPPEVGSDCT

SEQ ID NO: 28780 - protein, 21 aa, Artificial Sequence
  Description of Artificial Sequence: Synthetic peptide
  Seed: TFRHSVVVPCEPPEVGSDCTT (TP53 Y220C)
  Core: RHSVVVPCE
  misc_feature (3)..(3): Xaa can be , or Arg
  misc_feature (6)..(6): Xaa can be Ala, Ile, Leu, Met, or Val
  misc_feature (8)..(8): Xaa can be Ala, Ile, or Val
  misc_feature (11)..(11): Xaa can be Ala, Ile, Asn, Ser, or Val
TFXHSXVXPCXPPEVGSDCTT

SEQ ID NO: 28781 - protein, 22 aa, Artificial Sequence
  Description of Artificial Sequence: Synthetic peptide
  Seed: TFRHSVVVPCEPPEVGSDCTTI (TP53 Y220C)
  Core: RHSVVVPCE
  misc_feature (3)..(3): Xaa can be Phe, or Arg
  misc_feature (6)..(6): Xaa can be Ala, Ile, Leu, Met, or Val
  misc_feature (8)..(8): Xaa can be Ala, Ile, or Val
  misc_feature (11)..(11): Xaa can be Ala, Ile, Asn, Ser, or Val
TFXHSXVXPCXPPEVGSDCTTI

SEQ ID NO: 28782 - protein, 23 aa, Artificial Sequence
  Description of Artificial Sequence: Synthetic peptide
  Seed: TFRHSVVVPCEPPEVGSDCTTIH (TP53 Y220C)
  Core: RHSVVVPCE
  misc_feature (3)..(3): Xaa can be Phe, or Arg
  misc_feature (6)..(6): Xaa can be Ala, Ile, Leu, Met, or Val
  misc_feature (8)..(8): Xaa can be Ala, Ile, or Val
  misc_feature (11)..(11): Xaa can be Ala, Ile, Asn, Ser, or Val
TFXHSXVXPCXPPEVGSDCTTIH

SEQ ID NO: 28783 - protein, 24 aa, Artificial Sequence
  Description of Artificial Sequence: Synthetic peptide
  Seed: TFRHSVVVPCEPPEVGSDCTTIHY (TP53 Y220C)
  Core: RHSVVVPCE
  misc_feature (3)..(3): Xaa can be Phe, or Arg
  misc_feature (6)..(6): Xaa can be Ala, Ile, Leu, Met, or Val
  misc_feature (8)..(8): Xaa can be Ala, Ile, or Val
  misc_feature (11)..(11): Xaa can be Ala, Ile, Leu, Asn, Ser, or Val
TFXHSXVXPCXPPEVGSDCTTIHY

SEQ ID NO: 28784 - protein, 25 aa, Artificial Sequence
  Description of Artificial Sequence: Synthetic peptide
  Seed: TFRHSVVVPCEPPEVGSDCTTIHYN (TP53 Y220C)
  Core: RHSVVVPCE
  misc_feature (3)..(3): Xaa can be Phe, or Arg
  misc_feature (6)..(6): Xaa can be Ala, Ile, Leu, Met, Ser, or Val
  misc_feature (8)..(8): Xaa can be Ala, Ile, or Val
  misc_feature (11)..(11): Xaa can be Ala, Ile, Leu, Asn, Ser, or Val
TFXHSXVXPCXPPEVGSDCTTIHYN

SEQ ID NO: 28785 - protein, 22 aa, Artificial Sequence
  Description of Artificial Sequence: Synthetic peptide
  Seed: VEYLDDRNTFRHSVVVPCEPPE (TP53 Y220C)
  Core: RHSVVVPCE
  misc_feature (11)..(11): Xaa can be Phe, or Arg
  misc_feature (14)..(14): Xaa can be Phe, Ile, Leu, Met, Thr, or Val
  misc_feature (16)..(16): Xaa can be Ala, Phe, Ile, Leu, Met, or Val
  misc_feature (19)..(19): Xaa can be Ala, Glu, His, Ile, Lys, Leu, Met, Asn, Gln, Arg, Ser, Thr, or Val
VEYLDDRNTFXHSXVXPCXPPE

SEQ ID NO: 28786 - protein, 23 aa, Artificial Sequence
  Description of Artificial Sequence: Synthetic peptide
  Seed: VEYLDDRNTFRHSVVVPCEPPEV (TP53 Y220C)
  Core: RHSVVVPCE
  misc_feature (11)..(11): Xaa can be Phe, or Arg
  misc_feature (14)..(14): Xaa can be Phe, Ile, Leu, Met, Ser, Thr, Val, or Trp
  misc_feature (16)..(16): Xaa can be Ala, Phe, Ile, Leu, Met, or Val
  misc_feature (19)..(19): Xaa can be Ala, Asp, Glu, His, Ile, Lys, Leu, Met, Asn, Gln, Arg, Ser, Thr, or Val
VEYLDDRNTFXHSXVXPCXPPEV

SEQ ID NO: 28787 - protein, 24 aa, Artificial Sequence
  Description of Artificial Sequence: Synthetic peptide
  Seed: VEYLDDRNTFRHSVVVPCEPPEVG (TP53 Y220C)
  Core: RHSVVVPCE
  misc_feature (11)..(11): Xaa can be Phe, Leu, or Arg
  misc_feature (14)..(14): Xaa can be Ala, Phe, Ile, Leu, Met, Ser, Thr, Val, or Trp
  misc_feature (16)..(16): Xaa can be Ala, Phe, Ile, Leu, Met, or Val
  misc_feature (19)..(19): Xaa can be Ala, Asp, Glu, His, Ile, Lys, Leu, Met, Asn, Gln, Arg, Ser, Thr, or Val
VEYLDDRNTFXHSXVXPCXPPEVG

SEQ ID NO: 28788 - protein, 25 aa, Artificial Sequence
  Description of Artificial Sequence: Synthetic peptide
  Seed: VEYLDDRNTFRHSVVVPCEPPEVGS (TP53 Y220C)
  Core: RHSVVVPCE
  misc_feature (11)..(11): Xaa can be Phe, Leu, or Arg
  misc_feature (14)..(14): Xaa can be Ala, Phe, Ile, Leu, Met, Ser, Thr, Val, or Trp
  misc_feature (16)..(16): Xaa can be Ala, Phe, Ile, Leu, Met, or Val
  misc_feature (19)..(19): Xaa can be Ala, Asp, Glu, His, Ile, Lys, Leu, Met, Asn, Gln, Arg, Ser, Thr, or Val
VEYLDDRNTFXHSXVXPCXPPEVGS

SEQ ID NO: 28789 - protein, 19 aa, Artificial Sequence
  Description of Artificial Sequence: Synthetic peptide
  Seed: YLDDRNTFRHSVVVPCEPP (TP53 Y220C)
  Core: RHSVVVPCE
  misc_feature (9)..(9): Xaa can be Phe, or Arg
  misc_feature (12)..(12): Xaa can be Ala, Glu, Phe, Ile, Met, Ser, Thr, or Val
  misc_feature (14)..(14): Xaa can be Phe, Ile, or Val
  misc_feature (17)..(17): Xaa can be Ile, Leu, Met, Asn, or Val
YLDDRNTFXHSXVXPCXPP

SEQ ID NO: 28790 - protein, 20 aa, Artificial Sequence
  Description of Artificial Sequence: Synthetic peptide
  Seed: YLDDRNTFRHSVVVPCEPPE (TP53 Y220C)
  Core: RHSVVVPCE
  misc_feature (9)..(9): Xaa can be Ala, Phe, Ile, Lys, Leu, Met, Gln, Arg, Val, Trp, or Tyr
  misc_feature (12)..(12): Xaa can be Ala, Glu, Phe, His, Ile, Leu, Met, Gln, Ser, Thr, Val, Trp, or Tyr
  misc_feature (14)..(14): Xaa can be Ala, Phe, Ile, Leu, Met, Pro, Ser, or Val
  misc_feature (17)..(17): Xaa can be Ala, Cys, Asp, Glu, Gly, His, Ile, Lys, Leu, Met, Asn, Pro, Gln, Arg, Ser, Thr, Val, or Ty r
YLDDRNTFXHSXVXPCXPPE

SEQ ID NO: 28791 - protein, 21 aa, Artificial Sequence
  Description of Artificial Sequence: Synthetic peptide
  Seed: YLDDRNTFRHSVVVPCEPPEV (TP53 Y220C)
  Core: RHSVVVPCE
  misc_feature (9)..(9): Xaa can be Phe, or Arg
  misc_feature (12)..(12): Xaa can be Phe, Ile, Leu, Met, Thr, or Val
  misc_feature (14)..(14): Xaa can be Ala, Phe, Ile, Leu, Met, or Val
  misc_feature (17)..(17): Xaa can be Ala, Glu, His, Ile, Lys, Leu, Met, Asn, Gln, Arg, Ser, Thr, or Val
YLDDRNTFXHSXVXPCXPPEV

SEQ ID NO: 28792 - protein, 22 aa, Artificial Sequence
  Description of Artificial Sequence: Synthetic peptide
  Seed: YLDDRNTFRHSVVVPCEPPEVG (TP53 Y220C)
  Core: RHSVVVPCE
  misc_feature (9)..(9): Xaa can be Phe, or Arg
  misc_feature (12)..(12): Xaa can be Phe, Ile, Leu, Met, Thr, or Val
  misc_feature (14)..(14): Xaa can be Ala, Phe, Ile, Leu, Met, or Val
  misc_feature (17)..(17): Xaa can be Ala, Glu, His, Ile, Lys, Leu, Met, Asn, Gln, Arg, Ser, Thr, or Val
YLDDRNTFXHSXVXPCXPPEVG

SEQ ID NO: 28793 - protein, 23 aa, Artificial Sequence
  Description of Artificial Sequence: Synthetic peptide
  Seed: YLDDRNTFRHSVVVPCEPPEVGS (TP53 Y220C)
  Core: RHSVVVPCE
  misc_feature (9)..(9): Xaa can be Phe, or Arg
  misc_feature (12)..(12): Xaa can be Phe, Ile, Leu, Met, Ser, Thr, Val, or Trp
  misc_feature (14)..(14): Xaa can be Ala, Phe, Ile, Leu, Met, or Val
  misc_feature (17)..(17): Xaa can be Ala, Asp, Glu, His, Ile, Lys, Leu, Met, Asn, Gln, Arg, Ser, Thr, or Val
YLDDRNTFXHSXVXPCXPPEVGS

SEQ ID NO: 28794 - protein, 24 aa, Artificial Sequence
  Description of Artificial Sequence: Synthetic peptide
  Seed: YLDDRNTFRHSVVVPCEPPEVGSD (TP53 Y220C)
  Core: RHSVVVPCE
  misc_feature (9)..(9): Xaa can be Phe, Leu, or Arg
  misc_feature (12)..(12): Xaa can be Phe, Ile, Leu, Met, Ser, Thr, Val, or Trp
  misc_feature (14)..(14): Xaa can be Ala, Phe, Ile, Leu, Met, or Val
  misc_feature (17)..(17): Xaa can be Ala, Asp, Glu, His, Ile, Lys, Leu, Met, Asn, Gln, Arg, Ser, Thr, or Val
YLDDRNTFXHSXVXPCXPPEVGSD

SEQ ID NO: 28795 - protein, 25 aa, Artificial Sequence
  Description of Artificial Sequence: Synthetic peptide
  Seed: YLDDRNTFRHSVVVPCEPPEVGSDC (TP53 Y220C)
  Core: RHSVVVPCE
  misc_feature (9)..(9): Xaa can be Phe, Leu, or Arg
  misc_feature (12)..(12): Xaa can be Phe, Ile, Leu, Met, Ser, Thr, Val, or Trp
  misc_feature (14)..(14): Xaa can be Ala, Phe, Ile, Leu, Met, or Val
  misc_feature (17)..(17): Xaa can be Ala, Asp, Glu, His, Ile, Lys, Leu, Met, Asn, Gln, Arg, Ser, Thr, or Val
YLDDRNTFXHSXVXPCXPPEVGSDC

SEQ ID NO: 28796 - protein, 9 aa, Artificial Sequence
  Description of Artificial Sequence: Synthetic peptide
  Seed: AQDAPPLPV (CTG1B_HUMAN)
ALDAPPLPL

SEQ ID NO: 28797 - protein, 10 aa, Artificial Sequence
  Description of Artificial Sequence: Synthetic peptide
  Seed: ATPMEAELAR (CTG1B_HUMAN)
ATPMEAELAK

SEQ ID NO: 28798 - protein, 9 aa, Artificial Sequence
  Description of Artificial Sequence: Synthetic peptide
  Seed: AARASGPGG (CTG1B_HUMAN)
ATRASGPGK

SEQ ID NO: 28799 - protein, 9 aa, Artificial Sequence
  Description of Artificial Sequence: Synthetic peptide
  Seed: AADHRQLQL (CTG1B_HUMAN)
AYDHRQLQL

SEQ ID NO: 28800 - protein, 9 aa, Artificial Sequence
  Description of Artificial Sequence: Synthetic peptide
  Seed: FATPMEAEL (CTG1B_HUMAN)
FRTPMEAEM

SEQ ID NO: 28801 - protein, 11 aa, Artificial Sequence
  Description of Artificial Sequence: Synthetic peptide
  Seed: FYLAMPFATPM (CTG1B_HUMAN)
FYLAMPFATPF

SEQ ID NO: 28802 - protein, 9 aa, Artificial Sequence
  Description of Artificial Sequence: Synthetic peptide
  Seed: ILTIRLTAA (CTG1B_HUMAN)
IMTIRLTAI

SEQ ID NO: 28803 - protein, 9 aa, Artificial Sequence
  Description of Artificial Sequence: Synthetic peptide
  Seed: ILTIRLTAA (CTG1B_HUMAN)
IMTIRLTAL

SEQ ID NO: 28804 - protein, 9 aa, Artificial Sequence
  Description of Artificial Sequence: Synthetic peptide
  Seed: ITQCFLPVF (CTG1B_HUMAN)
ISQCFLPVW

SEQ ID NO: 28805 - protein, 9 aa, Artificial Sequence
  Description of Artificial Sequence: Synthetic peptide
  Seed: ITQCFLPVF (CTG1B_HUMAN)
ITQCFLPVW

SEQ ID NO: 28806 - protein, 9 aa, Artificial Sequence
  Description of Artificial Sequence: Synthetic peptide
  Seed: LAMPFATPM (CTG1B_HUMAN)
LAMPFATPF

SEQ ID NO: 28807 - protein, 9 aa, Artificial Sequence
  Description of Artificial Sequence: Synthetic peptide
  Seed: LAMPFATPM (CTG1B_HUMAN)
LAMPFATPV

SEQ ID NO: 28808 - protein, 9 aa, Artificial Sequence
  Description of Artificial Sequence: Synthetic peptide
  Seed: LEFYLAMPF (CTG1B_HUMAN)
LEFYLAMPI

SEQ ID NO: 28809 - protein, 9 aa, Artificial Sequence
  Description of Artificial Sequence: Synthetic peptide
  Seed: LEFYLAMPF (CTG1B_HUMAN)
LEFYLAMPV

SEQ ID NO: 28810 - protein, 9 aa, Artificial Sequence
  Description of Artificial Sequence: Synthetic peptide
  Seed: LEFYLAMPF (CTG1B_HUMAN)
LEFYLAMPW

SEQ ID NO: 28811 - protein, 9 aa, Artificial Sequence
  Description of Artificial Sequence: Synthetic peptide
  Seed: LAMPFATPM (CTG1B_HUMAN)
LPMPFATPF

SEQ ID NO: 28812 - protein, 9 aa, Artificial Sequence
  Description of Artificial Sequence: Synthetic peptide
  Seed: LAMPFATPM (CTG1B_HUMAN)
LPMPFATPM

SEQ ID NO: 28813 - protein, 9 aa, Artificial Sequence
  Description of Artificial Sequence: Synthetic peptide
  Seed: LAMPFATPM (CTG1B_HUMAN)
LSMPFATPI

SEQ ID NO: 28814 - protein, 9 aa, Artificial Sequence
  Description of Artificial Sequence: Synthetic peptide
  Seed: MEAELARRS (CTG1B_HUMAN)
MEAELARRA

SEQ ID NO: 28815 - protein, 10 aa, Artificial Sequence
  Description of Artificial Sequence: Synthetic peptide
  Seed: MEAELARRSL (CTG1B_HUMAN)
MEAELARRSF

SEQ ID NO: 28816 - protein, 9 aa, Artificial Sequence
  Description of Artificial Sequence: Synthetic peptide
  Seed: MPFATPMEA (CTG1B_HUMAN)
MPFATPMEI

SEQ ID NO: 28817 - protein, 9 aa, Artificial Sequence
  Description of Artificial Sequence: Synthetic peptide
  Seed: MPFATPMEA (CTG1B_HUMAN)
MPFATPMEL

SEQ ID NO: 28818 - protein, 9 aa, Artificial Sequence
  Description of Artificial Sequence: Synthetic peptide
  Seed: MPFATPMEA (CTG1B_HUMAN)
MPFATPMEM

SEQ ID NO: 28819 - protein, 11 aa, Artificial Sequence
  Description of Artificial Sequence: Synthetic peptide
  Seed: MWITQCFLPVF (CTG1B_HUMAN)
MYITQCFLPVF

SEQ ID NO: 28820 - protein, 9 aa, Artificial Sequence
  Description of Artificial Sequence: Synthetic peptide
  Seed: RLLEFYLAM (CTG1B_HUMAN)
RQLEFYLAF

SEQ ID NO: 28821 - protein, 9 aa, Artificial Sequence
  Description of Artificial Sequence: Synthetic peptide
  Seed: RLLEFYLAM (CTG1B_HUMAN)
RQLEFYLAL

SEQ ID NO: 28822 - protein, 9 aa, Artificial Sequence
  Description of Artificial Sequence: Synthetic peptide
  Seed: RLLEFYLAM (CTG1B_HUMAN)
RQLEFYLAV

SEQ ID NO: 28823 - protein, 9 aa, Artificial Sequence
  Description of Artificial Sequence: Synthetic peptide
  Seed: RLLEFYLAM (CTG1B_HUMAN)
RQLEFYLAY

SEQ ID NO: 28824 - protein, 11 aa, Artificial Sequence
  Description of Artificial Sequence: Synthetic peptide
  Seed: RASGPGGGAPR (CTG1B_HUMAN)
RVSGPGGGAPR

SEQ ID NO: 28825 - protein, 10 aa, Artificial Sequence
  Description of Artificial Sequence: Synthetic peptide
  Seed: SRLLEFYLAM (CTG1B_HUMAN)
SRLLEFYLAL

SEQ ID NO: 28826 - protein, 9 aa, Artificial Sequence
  Description of Artificial Sequence: Synthetic peptide
  Seed: TVSGNILTI (CTG1B_HUMAN)
TASGNILTL

SEQ ID NO: 28827 - protein, 10 aa, Artificial Sequence
  Description of Artificial Sequence: Synthetic peptide
  Seed: TVSGNILTIR (CTG1B_HUMAN)
TTSGNILTIK

SEQ ID NO: 28828 - protein, 10 aa, Artificial Sequence
  Description of Artificial Sequence: Synthetic peptide
  Seed: YLAMPFATPM (CTG1B_HUMAN)
YMAMPFATPM

SEQ ID NO: 28829 - protein, 10 aa, Artificial Sequence
  Description of Artificial Sequence: Synthetic peptide
  Seed: YLAMPFATPM (CTG1B_HUMAN)
YMAMPFATPY

SEQ ID NO: 28830 - protein, 10 aa, Artificial Sequence
  Description of Artificial Sequence: Synthetic peptide
  Seed: YLAMPFATPM (CTG1B_HUMAN)
YVAMPFATPI

SEQ ID NO: 28831 - protein, 9 aa, Homo sapiens
  Native (CTG1B_HUMAN)
AADHRQLQL

SEQ ID NO: 28832 - protein, 9 aa, Homo sapiens
  Native (CTG1B_HUMAN)
AELARRSLA

SEQ ID NO: 28833 - protein, 10 aa, Homo sapiens
  Native (CTG1B_HUMAN)
APPLPVPGVL

SEQ ID NO: 28834 - protein, 10 aa, Homo sapiens
  Native (CTG1B_HUMAN)
APRGPHGGAA

SEQ ID NO: 28835 - protein, 9 aa, Homo sapiens
  Native (CTG1B_HUMAN)
AQDAPPLPV

SEQ ID NO: 28836 - protein, 11 aa, Homo sapiens
  Native (CTG1B_HUMAN)
ARGPESRLLEF

SEQ ID NO: 28837 - protein, 11 aa, Homo sapiens
  Native (CTG1B_HUMAN)
EAGATGGRGPR

SEQ ID NO: 28838 - protein, 9 aa, Homo sapiens
  Native (CTG1B_HUMAN)
FATPMEAEL

SEQ ID NO: 28839 - protein, 10 aa, Homo sapiens
  Native (CTG1B_HUMAN)
FTVSGNILTI

SEQ ID NO: 28840 - protein, 10 aa, Homo sapiens
  Native (CTG1B_HUMAN)
GPHGGAASGL

SEQ ID NO: 28841 - protein, 10 aa, Homo sapiens
  Native (CTG1B_HUMAN)
GPRGAGAARA

SEQ ID NO: 28842 - protein, 9 aa, Homo sapiens
  Native (CTG1B_HUMAN)
GVLLKEFTV

SEQ ID NO: 28843 - protein, 9 aa, Homo sapiens
  Native (CTG1B_HUMAN)
ILTIRLTAA

SEQ ID NO: 28844 - protein, 9 aa, Homo sapiens
  Native (CTG1B_HUMAN)
ITQCFLPVF

SEQ ID NO: 28845 - protein, 10 aa, Homo sapiens
  Native (CTG1B_HUMAN)
KEFTVSGNIL

SEQ ID NO: 28846 - protein, 9 aa, Homo sapiens
  Native (CTG1B_HUMAN)
LAMPFATPM

SEQ ID NO: 28847 - protein, 9 aa, Homo sapiens
  Native (CTG1B_HUMAN)
LAQPPSGQR

SEQ ID NO: 28848 - protein, 9 aa, Homo sapiens
  Native (CTG1B_HUMAN)
LEFYLAMPF

SEQ ID NO: 28849 - protein, 9 aa, Homo sapiens
  Native (CTG1B_HUMAN)
LLMWITQCF

SEQ ID NO: 28850 - protein, 10 aa, Homo sapiens
  Native (CTG1B_HUMAN)
LLMWITQCFL

SEQ ID NO: 28851 - protein, 11 aa, Homo sapiens
  Native (CTG1B_HUMAN)
LPVPGVLLKEF

SEQ ID NO: 28852 - protein, 9 aa, Homo sapiens
  Native (CTG1B_HUMAN)
LQLSISSCL

SEQ ID NO: 28853 - protein, 9 aa, Homo sapiens
  Native (CTG1B_HUMAN)
LTAADHRQL

SEQ ID NO: 28854 - protein, 9 aa, Homo sapiens
  Native (CTG1B_HUMAN)
MPFATPMEA

SEQ ID NO: 28855 - protein, 11 aa, Homo sapiens
  Native (CTG1B_HUMAN)
MWITQCFLPVF

SEQ ID NO: 28856 - protein, 9 aa, Homo sapiens
  Native (CTG1B_HUMAN)
QQLSLLMWI

SEQ ID NO: 28857 - protein, 11 aa, Homo sapiens
  Native (CTG1B_HUMAN)
RASGPGGGAPR

SEQ ID NO: 28858 - protein, 9 aa, Homo sapiens
  Native (CTG1B_HUMAN)
RLLEFYLAM

SEQ ID NO: 28859 - protein, 9 aa, Homo sapiens
  Native (CTG1B_HUMAN)
SISSCLQQL

SEQ ID NO: 28860 - protein, 9 aa, Homo sapiens
  Native (CTG1B_HUMAN)
SLAQDAPPL

SEQ ID NO: 28861 - protein, 10 aa, Homo sapiens
  Native (CTG1B_HUMAN)
SRLLEFYLAM

SEQ ID NO: 28862 - protein, 9 aa, Homo sapiens
  Native (CTG1B_HUMAN)
SSCLQQLSL

SEQ ID NO: 28863 - protein, 10 aa, Homo sapiens
  Native (CTG1B_HUMAN)
TVSGNILTIR

SEQ ID NO: 28864 - protein, 10 aa, Homo sapiens
  Native (CTG1B_HUMAN)
YLAMPFATPM

SEQ ID NO: 28865 - protein, 10 aa, Artificial Sequence
  Description of Artificial Sequence: Synthetic peptide
  Seed: KEFTVSGNIL (CTG1B_HUMAN)
KLFTVSGNIY

SEQ ID NO: 28866 - protein, 9 aa, Artificial Sequence
  Description of Artificial Sequence: Synthetic peptide
  Seed: FATPMEAEL (CTG1B_HUMAN)
FVTPMEAEL

SEQ ID NO: 28867 - protein, 9 aa, Artificial Sequence
  Description of Artificial Sequence: Synthetic peptide
  Seed: RLLEFYLAM (CTG1B_HUMAN)
RELEFYLAM

SEQ ID NO: 28868 - protein, 9 aa, Artificial Sequence
  Description of Artificial Sequence: Synthetic peptide
  Seed: LPVPGVLLK (CTG1B_HUMAN)
LPVPGVLLF

SEQ ID NO: 28869 - protein, 10 aa, Artificial Sequence
  Description of Artificial Sequence: Synthetic peptide
  Seed: AMPFATPMEA (CTG1B_HUMAN)
AMPFATPMEV

SEQ ID NO: 28870 - protein, 10 aa, Artificial Sequence
  Description of Artificial Sequence: Synthetic peptide
  Seed: APRGPHGGAA (CTG1B_HUMAN)
APRGPHGGAF

SEQ ID NO: 28871 - protein, 10 aa, Artificial Sequence
  Description of Artificial Sequence: Synthetic peptide
  Seed: FLPVFLAQPP (CTG1B_HUMAN)
FEPVFLAQPA

SEQ ID NO: 28872 - protein, 10 aa, Artificial Sequence
  Description of Artificial Sequence: Synthetic peptide
  Seed: LSISSCLQQL (CTG1B_HUMAN)
LLISSCLQQV

SEQ ID NO: 28873 - protein, 11 aa, Artificial Sequence
  Description of Artificial Sequence: Synthetic peptide
  Seed: RQLQLSISSCL (CTG1B_HUMAN)
RCLQLSISSCY

SEQ ID NO: 28874 - protein, 9 aa, Artificial Sequence
  Description of Artificial Sequence: Synthetic peptide
  Seed: MPFATPMEA (CTG1B_HUMAN)
MGFATPMEL

SEQ ID NO: 28875 - protein, 10 aa, Artificial Sequence
  Description of Artificial Sequence: Synthetic peptide
  Seed: GAPRGPHGGA (CTG1B_HUMAN)
GRPRGPHGGL

SEQ ID NO: 28876 - protein, 9 aa, Artificial Sequence
  Description of Artificial Sequence: Synthetic peptide
  Seed: MPFATPMEA (CTG1B_HUMAN)
MSFATPMEM

SEQ ID NO: 28877 - protein, 10 aa, Artificial Sequence
  Description of Artificial Sequence: Synthetic peptide
  Seed: RQLQLSISSC (CTG1B_HUMAN)
RQLQLSISSI

SEQ ID NO: 28878 - protein, 10 aa, Artificial Sequence
  Description of Artificial Sequence: Synthetic peptide
  Seed: WITQCFLPVF (CTG1B_HUMAN)
WLTQCFLPVY

SEQ ID NO: 28879 - protein, 9 aa, Artificial Sequence
  Description of Artificial Sequence: Synthetic peptide
  Seed: LQLSISSCL (CTG1B_HUMAN)
LKLSISSCL

SEQ ID NO: 28880 - protein, 9 aa, Artificial Sequence
  Description of Artificial Sequence: Synthetic peptide
  Seed: ASGPGGGAP (CTG1B_HUMAN)
AAGPGGGAH

SEQ ID NO: 28881 - protein, 9 aa, Artificial Sequence
  Description of Artificial Sequence: Synthetic peptide
  Seed: RLLEFYLAM (CTG1B_HUMAN)
RLLEFYLAT

SEQ ID NO: 28882 - protein, 8 aa, Artificial Sequence
  Description of Artificial Sequence: Synthetic peptide
  Seed: YLAMPFAT (CTG1B_HUMAN)
YMAMPFAV

SEQ ID NO: 28883 - protein, 9 aa, Artificial Sequence
  Description of Artificial Sequence: Synthetic peptide
  Seed: FTVSGNILT (CTG1B_HUMAN)
FQVSGNILV

SEQ ID NO: 28884 - protein, 9 aa, Artificial Sequence
  Description of Artificial Sequence: Synthetic peptide
  Seed: LEFYLAMPF (CTG1B_HUMAN)
LNFYLAMPY

SEQ ID NO: 28885 - protein, 10 aa, Artificial Sequence
  Description of Artificial Sequence: Synthetic peptide
  Seed: RASGPGGGAP (CTG1B_HUMAN)
RSSGPGGGAM

SEQ ID NO: 28886 - protein, 9 aa, Artificial Sequence
  Description of Artificial Sequence: Synthetic peptide
  Seed: VPGVLLKEF (CTG1B_HUMAN)
VPGVLLKEA

SEQ ID NO: 28887 - protein, 10 aa, Artificial Sequence
  Description of Artificial Sequence: Synthetic peptide
  Seed: SRLLEFYLAM (CTG1B_HUMAN)
SALLEFYLAA

SEQ ID NO: 28888 - protein, 10 aa, Artificial Sequence
  Description of Artificial Sequence: Synthetic peptide
  Seed: FLAQPPSGQR (CTG1B_HUMAN)
FSAQPPSGQL

SEQ ID NO: 28889 - protein, 9 aa, Artificial Sequence
  Description of Artificial Sequence: Synthetic peptide
  Seed: RLLEFYLAM (CTG1B_HUMAN)
RLLEFYLAS

SEQ ID NO: 28890 - protein, 9 aa, Artificial Sequence
  Description of Artificial Sequence: Synthetic peptide
  Seed: RQLQLSISS (CTG1B_HUMAN)
RTLQLSISV

SEQ ID NO: 28891 - protein, 9 aa, Artificial Sequence
  Description of Artificial Sequence: Synthetic peptide
  Seed: LLMWITQCF (CTG1B_HUMAN)
LYMWITQCL

SEQ ID NO: 28892 - protein, 9 aa, Artificial Sequence
  Description of Artificial Sequence: Synthetic peptide
  Seed: TAADHRQLQ (CTG1B_HUMAN)
TIADHRQLM

SEQ ID NO: 28893 - protein, 9 aa, Artificial Sequence
  Description of Artificial Sequence: Synthetic peptide
  Seed: WITQCFLPV (CTG1B_HUMAN)
WMTQCFLPM

SEQ ID NO: 28894 - protein, 9 aa, Artificial Sequence
  Description of Artificial Sequence: Synthetic peptide
  Seed: SISSCLQQL (CTG1B_HUMAN)
SRSSCLQQF

SEQ ID NO: 28895 - protein, 10 aa, Artificial Sequence
  Description of Artificial Sequence: Synthetic peptide
  Seed: RGPHGGAASG (CTG1B_HUMAN)
RTPHGGAASM

SEQ ID NO: 28896 - protein, 10 aa, Artificial Sequence
  Description of Artificial Sequence: Synthetic peptide
  Seed: EFTVSGNILT (CTG1B_HUMAN)
ERTVSGNILI

SEQ ID NO: 28897 - protein, 9 aa, Artificial Sequence
  Description of Artificial Sequence: Synthetic peptide
  Seed: LLMWITQCF (CTG1B_HUMAN)
LPMWITQCF

SEQ ID NO: 28898 - protein, 9 aa, Artificial Sequence
  Description of Artificial Sequence: Synthetic peptide
  Seed: YLAMPFATP (CTG1B_HUMAN)
YSAMPFATV

SEQ ID NO: 28899 - protein, 9 aa, Artificial Sequence
  Description of Artificial Sequence: Synthetic peptide
  Seed: ARGPESRLL (CTG1B_HUMAN)
AHGPESRLI

SEQ ID NO: 28900 - protein, 10 aa, Artificial Sequence
  Description of Artificial Sequence: Synthetic peptide
  Seed: RGPESRLLEF (CTG1B_HUMAN)
RPPESRLLEM

SEQ ID NO: 28901 - protein, 10 aa, Artificial Sequence
  Description of Artificial Sequence: Synthetic peptide
  Seed: LQQLSLLMWI (CTG1B_HUMAN)
LIQLSLLMWV

SEQ ID NO: 28902 - protein, 9 aa, Artificial Sequence
  Description of Artificial Sequence: Synthetic peptide
  Seed: AQDAPPLPV (CTG1B_HUMAN)
AEDAPPLPT

SEQ ID NO: 28903 - protein, 9 aa, Artificial Sequence
  Description of Artificial Sequence: Synthetic peptide
  Seed: SSCLQQLSL (CTG1B_HUMAN)
SMCLQQLSV

SEQ ID NO: 28904 - protein, 8 aa, Artificial Sequence
  Description of Artificial Sequence: Synthetic peptide
  Seed: MPFATPME (CTG1B_HUMAN)
MPFATPMY

SEQ ID NO: 28905 - protein, 9 aa, Artificial Sequence
  Description of Artificial Sequence: Synthetic peptide
  Seed: AADHRQLQL (CTG1B_HUMAN)
AWDHRQLQF

SEQ ID NO: 28906 - protein, 11 aa, Artificial Sequence
  Description of Artificial Sequence: Synthetic peptide
  Seed: FYLAMPFATPM (CTG1B_HUMAN)
FYLAMPFATPI

SEQ ID NO: 28907 - protein, 10 aa, Artificial Sequence
  Description of Artificial Sequence: Synthetic peptide
  Seed: LLEFYLAMPF (CTG1B_HUMAN)
LGEFYLAMPL

SEQ ID NO: 28908 - protein, 10 aa, Artificial Sequence
  Description of Artificial Sequence: Synthetic peptide
  Seed: MWITQCFLPV (CTG1B_HUMAN)
MAITQCFLPV

SEQ ID NO: 28909 - protein, 10 aa, Artificial Sequence
  Description of Artificial Sequence: Synthetic peptide
  Seed: RASGPGGGAP (CTG1B_HUMAN)
RASGPGGGAH

SEQ ID NO: 28910 - protein, 9 aa, Artificial Sequence
  Description of Artificial Sequence: Synthetic peptide
  Seed: QQLSLLMWI (CTG1B_HUMAN)
QMLSLLMWT

SEQ ID NO: 28911 - protein, 10 aa, Artificial Sequence
  Description of Artificial Sequence: Synthetic peptide
  Seed: FTVSGNILTI (CTG1B_HUMAN)
FNVSGNILTV

SEQ ID NO: 28912 - protein, 11 aa, Artificial Sequence
  Description of Artificial Sequence: Synthetic peptide
  Seed: GAPRGPHGGAA (CTG1B_HUMAN)
GMPRGPHGGAI

SEQ ID NO: 28913 - protein, 9 aa, Artificial Sequence
  Description of Artificial Sequence: Synthetic peptide
  Seed: LEFYLAMPF (CTG1B_HUMAN)
LSFYLAMPL

SEQ ID NO: 28914 - protein, 9 aa, Artificial Sequence
  Description of Artificial Sequence: Synthetic peptide
  Seed: LLMWITQCF (CTG1B_HUMAN)
LTMWITQCF

SEQ ID NO: 28915 - protein, 10 aa, Artificial Sequence
  Description of Artificial Sequence: Synthetic peptide
  Seed: MPFATPMEAE (CTG1B_HUMAN)
MQFATPMEAY

SEQ ID NO: 28916 - protein, 10 aa, Artificial Sequence
  Description of Artificial Sequence: Synthetic peptide
  Seed: RGPRGAGAAR (CTG1B_HUMAN)
RSPRGAGAAR

SEQ ID NO: 28917 - protein, 9 aa, Artificial Sequence
  Description of Artificial Sequence: Synthetic peptide
  Seed: AQDAPPLPV (CTG1B_HUMAN)
AIDAPPLPF

SEQ ID NO: 28918 - protein, 10 aa, Artificial Sequence
  Description of Artificial Sequence: Synthetic peptide
  Seed: RGPHGGAASG (CTG1B_HUMAN)
RTPHGGAASA

SEQ ID NO: 28919 - protein, 11 aa, Artificial Sequence
  Description of Artificial Sequence: Synthetic peptide
  Seed: GEAGATGGRGP (CTG1B_HUMAN)
GEAGATGGRGL

SEQ ID NO: 28920 - protein, 10 aa, Artificial Sequence
  Description of Artificial Sequence: Synthetic peptide
  Seed: SRLLEFYLAM (CTG1B_HUMAN)
SNLLEFYLAV

SEQ ID NO: 28921 - protein, 10 aa, Artificial Sequence
  Description of Artificial Sequence: Synthetic peptide
  Seed: LLMWITQCFL (CTG1B_HUMAN)
LSMWITQCFI

SEQ ID NO: 28922 - protein, 9 aa, Artificial Sequence
  Description of Artificial Sequence: Synthetic peptide
  Seed: RLLEFYLAM (CTG1B_HUMAN)
RQLEFYLAM

SEQ ID NO: 28923 - protein, 9 aa, Artificial Sequence
  Description of Artificial Sequence: Synthetic peptide
  Seed: IPDGPGGNA (CTG1B_HUMAN)
IGDGPGGNF

SEQ ID NO: 28924 - protein, 10 aa, Artificial Sequence
  Description of Artificial Sequence: Synthetic peptide
  Seed: FYLAMPFATP (CTG1B_HUMAN)
FYLAMPFATM

SEQ ID NO: 28925 - protein, 10 aa, Artificial Sequence
  Description of Artificial Sequence: Synthetic peptide
  Seed: ISSCLQQLSL (CTG1B_HUMAN)
IASCLQQLSW

SEQ ID NO: 28926 - protein, 10 aa, Artificial Sequence
  Description of Artificial Sequence: Synthetic peptide
  Seed: YLAMPFATPM (CTG1B_HUMAN)
YLAMPFATPC

SEQ ID NO: 28927 - protein, 9 aa, Artificial Sequence
  Description of Artificial Sequence: Synthetic peptide
  Seed: APPLPVPGV (CTG1B_HUMAN)
AAPLPVPGV

SEQ ID NO: 28928 - protein, 10 aa, Artificial Sequence
  Description of Artificial Sequence: Synthetic peptide
  Seed: LLMWITQCFL (CTG1B_HUMAN)
LMMWITQCFR

SEQ ID NO: 28929 - protein, 10 aa, Artificial Sequence
  Description of Artificial Sequence: Synthetic peptide
  Seed: LQQLSLLMWI (CTG1B_HUMAN)
LFQLSLLMWV

SEQ ID NO: 28930 - protein, 9 aa, Artificial Sequence
  Description of Artificial Sequence: Synthetic peptide
  Seed: SSCLQQLSL (CTG1B_HUMAN)
SRCLQQLSL

SEQ ID NO: 28931 - protein, 10 aa, Artificial Sequence
  Description of Artificial Sequence: Synthetic peptide
  Seed: RSLAQDAPPL (CTG1B_HUMAN)
RELAQDAPPV

SEQ ID NO: 28932 - protein, 10 aa, Artificial Sequence
  Description of Artificial Sequence: Synthetic peptide
  Seed: YLAMPFATPM (CTG1B_HUMAN)
YYAMPFATPI

SEQ ID NO: 28933 - protein, 9 aa, Artificial Sequence
  Description of Artificial Sequence: Synthetic peptide
  Seed: RLLEFYLAM (CTG1B_HUMAN)
RRLEFYLAI

SEQ ID NO: 28934 - protein, 11 aa, Artificial Sequence
  Description of Artificial Sequence: Synthetic peptide
  Seed: EAGATGGRGPR (CTG1B_HUMAN)
EIGATGGRGPR

SEQ ID NO: 28935 - protein, 9 aa, Artificial Sequence
  Description of Artificial Sequence: Synthetic peptide
  Seed: LLMWITQCF (CTG1B_HUMAN)
LRMWITQCF

SEQ ID NO: 28936 - protein, 10 aa, Artificial Sequence
  Description of Artificial Sequence: Synthetic peptide
  Seed: AMPFATPMEA (CTG1B_HUMAN)
AIPFATPMEY

SEQ ID NO: 28937 - protein, 9 aa, Artificial Sequence
  Description of Artificial Sequence: Synthetic peptide
  Seed: KEFTVSGNI (CTG1B_HUMAN)
KEFTVSGNM

SEQ ID NO: 28938 - protein, 9 aa, Artificial Sequence
  Description of Artificial Sequence: Synthetic peptide
  Seed: SLAQDAPPL (CTG1B_HUMAN)
SSAQDAPPY

SEQ ID NO: 28939 - protein, 10 aa, Artificial Sequence
  Description of Artificial Sequence: Synthetic peptide
  Seed: RLLEFYLAMP (CTG1B_HUMAN)
RLLEFYLAMA

SEQ ID NO: 28940 - protein, 9 aa, Artificial Sequence
  Description of Artificial Sequence: Synthetic peptide
  Seed: DHRQLQLSI (CTG1B_HUMAN)
DHRQLQLSL

SEQ ID NO: 28941 - protein, 10 aa, Artificial Sequence
  Description of Artificial Sequence: Synthetic peptide
  Seed: KEFTVSGNIL (CTG1B_HUMAN)
KQFTVSGNIY

SEQ ID NO: 28942 - protein, 10 aa, Artificial Sequence
  Description of Artificial Sequence: Synthetic peptide
  Seed: LLEFYLAMPF (CTG1B_HUMAN)
LQEFYLAMPL

SEQ ID NO: 28943 - protein, 9 aa, Artificial Sequence
  Description of Artificial Sequence: Synthetic peptide
  Seed: FTVSGNILT (CTG1B_HUMAN)
FIVSGNILM

SEQ ID NO: 28944 - protein, 10 aa, Artificial Sequence
  Description of Artificial Sequence: Synthetic peptide
  Seed: LSISSCLQQL (CTG1B_HUMAN)
LIISSCLQQV

SEQ ID NO: 28945 - protein, 9 aa, Artificial Sequence
  Description of Artificial Sequence: Synthetic peptide
  Seed: LPVPGVLLK (CTG1B_HUMAN)
LSVPGVLLY

SEQ ID NO: 28946 - protein, 10 aa, Artificial Sequence
  Description of Artificial Sequence: Synthetic peptide
  Seed: RGPHGGAASG (CTG1B_HUMAN)
RTPHGGAASI

SEQ ID NO: 28947 - protein, 10 aa, Artificial Sequence
  Description of Artificial Sequence: Synthetic peptide
  Seed: ASGPGGGAPR (CTG1B_HUMAN)
AVGPGGGAPM

SEQ ID NO: 28948 - protein, 10 aa, Artificial Sequence
  Description of Artificial Sequence: Synthetic peptide
  Seed: SRLLEFYLAM (CTG1B_HUMAN)
STLLEFYLAI

SEQ ID NO: 28949 - protein, 10 aa, Artificial Sequence
  Description of Artificial Sequence: Synthetic peptide
  Seed: YLAMPFATPM (CTG1B_HUMAN)
YWAMPFATPM

SEQ ID NO: 28950 - protein, 10 aa, Artificial Sequence
  Description of Artificial Sequence: Synthetic peptide
  Seed: SRLLEFYLAM (CTG1B_HUMAN)
SNLLEFYLAA

SEQ ID NO: 28951 - protein, 10 aa, Artificial Sequence
  Description of Artificial Sequence: Synthetic peptide
  Seed: RGPESRLLEF (CTG1B_HUMAN)
RYPESRLLEL

SEQ ID NO: 28952 - protein, 9 aa, Artificial Sequence
  Description of Artificial Sequence: Synthetic peptide
  Seed: SGPGGGAPR (CTG1B_HUMAN)
SSPGGGAPY

SEQ ID NO: 28953 - protein, 9 aa, Artificial Sequence
  Description of Artificial Sequence: Synthetic peptide
  Seed: GVLLKEFTV (CTG1B_HUMAN)
GLLLKEFTA

SEQ ID NO: 28954 - protein, 11 aa, Artificial Sequence
  Description of Artificial Sequence: Synthetic peptide
  Seed: LAMPFATPMEA (CTG1B_HUMAN)
LVMPFATPMEA

SEQ ID NO: 28955 - protein, 9 aa, Artificial Sequence
  Description of Artificial Sequence: Synthetic peptide
  Seed: QQLSLLMWI (CTG1B_HUMAN)
QTLSLLMWL

SEQ ID NO: 28956 - protein, 11 aa, Artificial Sequence
  Description of Artificial Sequence: Synthetic peptide
  Seed: FYLAMPFATPM (CTG1B_HUMAN)
FQLAMPFATPL

SEQ ID NO: 28957 - protein, 9 aa, Artificial Sequence
  Description of Artificial Sequence: Synthetic peptide
  Seed: MQAEGRGTG (CTG1B_HUMAN)
MNAEGRGTY

SEQ ID NO: 28958 - protein, 9 aa, Artificial Sequence
  Description of Artificial Sequence: Synthetic peptide
  Seed: LAMPFATPM (CTG1B_HUMAN)
LAMPFATPA

SEQ ID NO: 28959 - protein, 9 aa, Artificial Sequence
  Description of Artificial Sequence: Synthetic peptide
  Seed: AARASGPGG (CTG1B_HUMAN)
AMRASGPGV

SEQ ID NO: 28960 - protein, 10 aa, Artificial Sequence
  Description of Artificial Sequence: Synthetic peptide
  Seed: LSISSCLQQL (CTG1B_HUMAN)
LMISSCLQQW

SEQ ID NO: 28961 - protein, 8 aa, Artificial Sequence
  Description of Artificial Sequence: Synthetic peptide
  Seed: EFYLAMPF (CTG1B_HUMAN)
EEYLAMPF

SEQ ID NO: 28962 - protein, 11 aa, Artificial Sequence
  Description of Artificial Sequence: Synthetic peptide
  Seed: GAPRGPHGGAA (CTG1B_HUMAN)
GYPRGPHGGAL

SEQ ID NO: 28963 - protein, 10 aa, Artificial Sequence
  Description of Artificial Sequence: Synthetic peptide
  Seed: LLEFYLAMPF (CTG1B_HUMAN)
LTEFYLAMPF

SEQ ID NO: 28964 - protein, 11 aa, Artificial Sequence
  Description of Artificial Sequence: Synthetic peptide
  Seed: RLLEFYLAMPF (CTG1B_HUMAN)
RFLEFYLAMPF

SEQ ID NO: 28965 - protein, 10 aa, Artificial Sequence
  Description of Artificial Sequence: Synthetic peptide
  Seed: LLEFYLAMPF (CTG1B_HUMAN)
LREFYLAMPY

SEQ ID NO: 28966 - protein, 10 aa, Artificial Sequence
  Description of Artificial Sequence: Synthetic peptide
  Seed: YLAMPFATPM (CTG1B_HUMAN)
YVAMPFATPV

SEQ ID NO: 28967 - protein, 10 aa, Artificial Sequence
  Description of Artificial Sequence: Synthetic peptide
  Seed: LMWITQCFLP (CTG1B_HUMAN)
LMWITQCFLA

SEQ ID NO: 28968 - protein, 11 aa, Artificial Sequence
  Description of Artificial Sequence: Synthetic peptide
  Seed: YLAMPFATPME (CTG1B_HUMAN)
YLAMPFATPML

SEQ ID NO: 28969 - protein, 11 aa, Artificial Sequence
  Description of Artificial Sequence: Synthetic peptide
  Seed: IPDGPGGNAGG (CTG1B_HUMAN)
IPDGPGGNAGY

SEQ ID NO: 28970 - protein, 9 aa, Artificial Sequence
  Description of Artificial Sequence: Synthetic peptide
  Seed: MPFATPMEA (CTG1B_HUMAN)
MVFATPMEV

SEQ ID NO: 28971 - protein, 9 aa, Artificial Sequence
  Description of Artificial Sequence: Synthetic peptide
  Seed: SISSCLQQL (CTG1B_HUMAN)
SSSSCLQQL

SEQ ID NO: 28972 - protein, 10 aa, Artificial Sequence
  Description of Artificial Sequence: Synthetic peptide
  Seed: FYLAMPFATP (CTG1B_HUMAN)
FTLAMPFATI

SEQ ID NO: 28973 - protein, 10 aa, Artificial Sequence
  Description of Artificial Sequence: Synthetic peptide
  Seed: RGPHGGAASG (CTG1B_HUMAN)
RRPHGGAASM

SEQ ID NO: 28974 - protein, 10 aa, Artificial Sequence
  Description of Artificial Sequence: Synthetic peptide
  Seed: KEFTVSGNIL (CTG1B_HUMAN)
KAFTVSGNIY

SEQ ID NO: 28975 - protein, 11 aa, Artificial Sequence
  Description of Artificial Sequence: Synthetic peptide
  Seed: RASGPGGGAPR (CTG1B_HUMAN)
RPSGPGGGAPM

SEQ ID NO: 28976 - protein, 10 aa, Artificial Sequence
  Description of Artificial Sequence: Synthetic peptide
  Seed: FYLAMPFATP (CTG1B_HUMAN)
FYLAMPFATI

SEQ ID NO: 28977 - protein, 9 aa, Artificial Sequence
  Description of Artificial Sequence: Synthetic peptide
  Seed: FLPVFLAQP (CTG1B_HUMAN)
FLPVFLAQT

SEQ ID NO: 28978 - protein, 9 aa, Artificial Sequence
  Description of Artificial Sequence: Synthetic peptide
  Seed: SLLMWITQC (CTG1B_HUMAN)
SMLMWITQL

SEQ ID NO: 28979 - protein, 10 aa, Artificial Sequence
  Description of Artificial Sequence: Synthetic peptide
  Seed: TPMEAELARR (CTG1B_HUMAN)
TYMEAELARR

SEQ ID NO: 28980 - protein, 10 aa, Artificial Sequence
  Description of Artificial Sequence: Synthetic peptide
  Seed: LLMWITQCFL (CTG1B_HUMAN)
LAMWITQCFI

SEQ ID NO: 28981 - protein, 10 aa, Artificial Sequence
  Description of Artificial Sequence: Synthetic peptide
  Seed: SRLLEFYLAM (CTG1B_HUMAN)
STLLEFYLAA

SEQ ID NO: 28982 - protein, 9 aa, Artificial Sequence
  Description of Artificial Sequence: Synthetic peptide
  Seed: MPFATPMEA (CTG1B_HUMAN)
MPFATPMEC

SEQ ID NO: 28983 - protein, 11 aa, Artificial Sequence
  Description of Artificial Sequence: Synthetic peptide
  Seed: RLLEFYLAMPF (CTG1B_HUMAN)
RPLEFYLAMPL

SEQ ID NO: 28984 - protein, 9 aa, Artificial Sequence
  Description of Artificial Sequence: Synthetic peptide
  Seed: SGPGGGAPR (CTG1B_HUMAN)
SYPGGGAPL

SEQ ID NO: 28985 - protein, 10 aa, Artificial Sequence
  Description of Artificial Sequence: Synthetic peptide
  Seed: YLAMPFATPM (CTG1B_HUMAN)
YYAMPFATPV

SEQ ID NO: 28986 - protein, 10 aa, Artificial Sequence
  Description of Artificial Sequence: Synthetic peptide
  Seed: EFTVSGNILT (CTG1B_HUMAN)
EQTVSGNILV

SEQ ID NO: 28987 - protein, 9 aa, Artificial Sequence
  Description of Artificial Sequence: Synthetic peptide
  Seed: LPVPGVLLK (CTG1B_HUMAN)
LSVPGVLLI

SEQ ID NO: 28988 - protein, 10 aa, Artificial Sequence
  Description of Artificial Sequence: Synthetic peptide
  Seed: RGPHGGAASG (CTG1B_HUMAN)
RRPHGGAASA

SEQ ID NO: 28989 - protein, 9 aa, Artificial Sequence
  Description of Artificial Sequence: Synthetic peptide
  Seed: APRGPHGGA (CTG1B_HUMAN)
APRGPHGGV

SEQ ID NO: 28990 - protein, 11 aa, Artificial Sequence
  Description of Artificial Sequence: Synthetic peptide
  Seed: RLLEFYLAMPF (CTG1B_HUMAN)
RCLEFYLAMPV

SEQ ID NO: 28991 - protein, 9 aa, Artificial Sequence
  Description of Artificial Sequence: Synthetic peptide
  Seed: ASGPGGGAP (CTG1B_HUMAN)
AAGPGGGAL

SEQ ID NO: 28992 - protein, 10 aa, Artificial Sequence
  Description of Artificial Sequence: Synthetic peptide
  Seed: FLPVFLAQPP (CTG1B_HUMAN)
FWPVFLAQPI

SEQ ID NO: 28993 - protein, 11 aa, Artificial Sequence
  Description of Artificial Sequence: Synthetic peptide
  Seed: RLLEFYLAMPF (CTG1B_HUMAN)
RELEFYLAMPM

SEQ ID NO: 28994 - protein, 9 aa, Artificial Sequence
  Description of Artificial Sequence: Synthetic peptide
  Seed: GPRGAGAAR (CTG1B_HUMAN)
GPRGAGAAP

SEQ ID NO: 28995 - protein, 11 aa, Artificial Sequence
  Description of Artificial Sequence: Synthetic peptide
  Seed: LAMPFATPMEA (CTG1B_HUMAN)
LGMPFATPMEA

SEQ ID NO: 28996 - protein, 10 aa, Artificial Sequence
  Description of Artificial Sequence: Synthetic peptide
  Seed: YLAMPFATPM (CTG1B_HUMAN)
YNAMPFATPA

SEQ ID NO: 28997 - protein, 10 aa, Artificial Sequence
  Description of Artificial Sequence: Synthetic peptide
  Seed: RGPRGAGAAR (CTG1B_HUMAN)
RVPRGAGAAR

SEQ ID NO: 28998 - protein, 9 aa, Artificial Sequence
  Description of Artificial Sequence: Synthetic peptide
  Seed: KEFTVSGNI (CTG1B_HUMAN)
KQFTVSGNI

SEQ ID NO: 28999 - protein, 9 aa, Artificial Sequence
  Description of Artificial Sequence: Synthetic peptide
  Seed: CLQQLSLLM (CTG1B_HUMAN)
CMQQLSLLV

SEQ ID NO: 29000 - protein, 10 aa, Artificial Sequence
  Description of Artificial Sequence: Synthetic peptide
  Seed: FLPVFLAQPP (CTG1B_HUMAN)
FNPVFLAQPV

SEQ ID NO: 29001 - protein, 11 aa, Artificial Sequence
  Description of Artificial Sequence: Synthetic peptide
  Seed: FYLAMPFATPM (CTG1B_HUMAN)
FELAMPFATPF

SEQ ID NO: 29002 - protein, 10 aa, Artificial Sequence
  Description of Artificial Sequence: Synthetic peptide
  Seed: SRLLEFYLAM (CTG1B_HUMAN)
SWLLEFYLAI

SEQ ID NO: 29003 - protein, 11 aa, Artificial Sequence
  Description of Artificial Sequence: Synthetic peptide
  Seed: YLAMPFATPME (CTG1B_HUMAN)
YHAMPFATPMV

SEQ ID NO: 29004 - protein, 9 aa, Artificial Sequence
  Description of Artificial Sequence: Synthetic peptide
  Seed: RLLEFYLAM (CTG1B_HUMAN)
RMLEFYLAY

SEQ ID NO: 29005 - protein, 10 aa, Artificial Sequence
  Description of Artificial Sequence: Synthetic peptide
  Seed: APRGPHGGAA (CTG1B_HUMAN)
AVRGPHGGAL

SEQ ID NO: 29006 - protein, 10 aa, Artificial Sequence
  Description of Artificial Sequence: Synthetic peptide
  Seed: WITQCFLPVF (CTG1B_HUMAN)
WMTQCFLPVY

SEQ ID NO: 29007 - protein, 10 aa, Artificial Sequence
  Description of Artificial Sequence: Synthetic peptide
  Seed: YLAMPFATPM (CTG1B_HUMAN)
YWAMPFATPW

SEQ ID NO: 29008 - protein, 9 aa, Artificial Sequence
  Description of Artificial Sequence: Synthetic peptide
  Seed: LQLSISSCL (CTG1B_HUMAN)
LLLSISSCM

SEQ ID NO: 29009 - protein, 10 aa, Artificial Sequence
  Description of Artificial Sequence: Synthetic peptide
  Seed: APRGPHGGAA (CTG1B_HUMAN)
AIRGPHGGAM

SEQ ID NO: 29010 - protein, 10 aa, Artificial Sequence
  Description of Artificial Sequence: Synthetic peptide
  Seed: RGPHGGAASG (CTG1B_HUMAN)
RHPHGGAASI

SEQ ID NO: 29011 - protein, 9 aa, Artificial Sequence
  Description of Artificial Sequence: Synthetic peptide
  Seed: YLAMPFATP (CTG1B_HUMAN)
YVAMPFATM

SEQ ID NO: 29012 - protein, 9 aa, Artificial Sequence
  Description of Artificial Sequence: Synthetic peptide
  Seed: MPFATPMEA (CTG1B_HUMAN)
MVFATPMEL

SEQ ID NO: 29013 - protein, 9 aa, Artificial Sequence
  Description of Artificial Sequence: Synthetic peptide
  Seed: LAMPFATPM (CTG1B_HUMAN)
LPMPFATPV

SEQ ID NO: 29014 - protein, 9 aa, Artificial Sequence
  Description of Artificial Sequence: Synthetic peptide
  Seed: MPFATPMEA (CTG1B_HUMAN)
MCFATPMEW

SEQ ID NO: 29015 - protein, 9 aa, Artificial Sequence
  Description of Artificial Sequence: Synthetic peptide
  Seed: YLAMPFATP (CTG1B_HUMAN)
YMAMPFATS

SEQ ID NO: 29016 - protein, 10 aa, Artificial Sequence
  Description of Artificial Sequence: Synthetic peptide
  Seed: GAPRGPHGGA (CTG1B_HUMAN)
GIPRGPHGGM

SEQ ID NO: 29017 - protein, 10 aa, Artificial Sequence
  Description of Artificial Sequence: Synthetic peptide
  Seed: LSISSCLQQL (CTG1B_HUMAN)
LLISSCLQQL

SEQ ID NO: 29018 - protein, 10 aa, Artificial Sequence
  Description of Artificial Sequence: Synthetic peptide
  Seed: LLEFYLAMPF (CTG1B_HUMAN)
LFEFYLAMPW

SEQ ID NO: 29019 - protein, 9 aa, Artificial Sequence
  Description of Artificial Sequence: Synthetic peptide
  Seed: LAMPFATPM (CTG1B_HUMAN)
LVMPFATPY

SEQ ID NO: 29020 - protein, 10 aa, Artificial Sequence
  Description of Artificial Sequence: Synthetic peptide
  Seed: SRLLEFYLAM (CTG1B_HUMAN)
SPLLEFYLAA

SEQ ID NO: 29021 - protein, 11 aa, Artificial Sequence
  Description of Artificial Sequence: Synthetic peptide
  Seed: RQLQLSISSCL (CTG1B_HUMAN)
RRLQLSISSCY

SEQ ID NO: 29022 - protein, 9 aa, Artificial Sequence
  Description of Artificial Sequence: Synthetic peptide
  Seed: LQQLSLLMW (CTG1B_HUMAN)
LKQLSLLMM

SEQ ID NO: 29023 - protein, 10 aa, Artificial Sequence
  Description of Artificial Sequence: Synthetic peptide
  Seed: LLEFYLAMPF (CTG1B_HUMAN)
LAEFYLAMPY

SEQ ID NO: 29024 - protein, 9 aa, Artificial Sequence
  Description of Artificial Sequence: Synthetic peptide
  Seed: QQLSLLMWI (CTG1B_HUMAN)
QVLSLLMWI

SEQ ID NO: 29025 - protein, 9 aa, Artificial Sequence
  Description of Artificial Sequence: Synthetic peptide
  Seed: RLLEFYLAM (CTG1B_HUMAN)
RALEFYLAV

SEQ ID NO: 29026 - protein, 10 aa, Artificial Sequence
  Description of Artificial Sequence: Synthetic peptide
  Seed: YLAMPFATPM (CTG1B_HUMAN)
YDAMPFATPV

SEQ ID NO: 29027 - protein, 11 aa, Artificial Sequence
  Description of Artificial Sequence: Synthetic peptide
  Seed: FYLAMPFATPM (CTG1B_HUMAN)
FKLAMPFATPY

SEQ ID NO: 29028 - protein, 9 aa, Artificial Sequence
  Description of Artificial Sequence: Synthetic peptide
  Seed: LAMPFATPM (CTG1B_HUMAN)
LLMPFATPS

SEQ ID NO: 29029 - protein, 11 aa, Artificial Sequence
  Description of Artificial Sequence: Synthetic peptide
  Seed: FYLAMPFATPM (CTG1B_HUMAN)
FTLAMPFATPV

SEQ ID NO: 29030 - protein, 9 aa, Artificial Sequence
  Description of Artificial Sequence: Synthetic peptide
  Seed: AARASGPGG (CTG1B_HUMAN)
ATRASGPGT

SEQ ID NO: 29031 - protein, 10 aa, Artificial Sequence
  Description of Artificial Sequence: Synthetic peptide
  Seed: FYLAMPFATP (CTG1B_HUMAN)
FELAMPFATL

SEQ ID NO: 29032 - protein, 10 aa, Artificial Sequence
  Description of Artificial Sequence: Synthetic peptide
  Seed: FLPVFLAQPP (CTG1B_HUMAN)
FCPVFLAQPA

SEQ ID NO: 29033 - protein, 10 aa, Artificial Sequence
  Description of Artificial Sequence: Synthetic peptide
  Seed: LLEFYLAMPF (CTG1B_HUMAN)
LQEFYLAMPY

SEQ ID NO: 29034 - protein, 9 aa, Artificial Sequence
  Description of Artificial Sequence: Synthetic peptide
  Seed: MQAEGRGTG (CTG1B_HUMAN)
MSAEGRGTF

SEQ ID NO: 29035 - protein, 9 aa, Artificial Sequence
  Description of Artificial Sequence: Synthetic peptide
  Seed: RLLEFYLAM (CTG1B_HUMAN)
RVLEFYLAW

SEQ ID NO: 29036 - protein, 10 aa, Artificial Sequence
  Description of Artificial Sequence: Synthetic peptide
  Seed: APRGPHGGAA (CTG1B_HUMAN)
APRGPHGGAC

SEQ ID NO: 29037 - protein, 10 aa, Artificial Sequence
  Description of Artificial Sequence: Synthetic peptide
  Seed: APPLPVPGVL (CTG1B_HUMAN)
AVPLPVPGVL

SEQ ID NO: 29038 - protein, 10 aa, Artificial Sequence
  Description of Artificial Sequence: Synthetic peptide
  Seed: FTVSGNILTI (CTG1B_HUMAN)
FAVSGNILTH

SEQ ID NO: 29039 - protein, 10 aa, Artificial Sequence
  Description of Artificial Sequence: Synthetic peptide
  Seed: EFTVSGNILT (CTG1B_HUMAN)
ELTVSGNILV

SEQ ID NO: 29040 - protein, 9 aa, Artificial Sequence
  Description of Artificial Sequence: Synthetic peptide
  Seed: SGPGGGAPR (CTG1B_HUMAN)
SVPGGGAPL

SEQ ID NO: 29041 - protein, 11 aa, Artificial Sequence
  Description of Artificial Sequence: Synthetic peptide
  Seed: YLAMPFATPME (CTG1B_HUMAN)
YEAMPFATPMV

SEQ ID NO: 29042 - protein, 10 aa, Artificial Sequence
  Description of Artificial Sequence: Synthetic peptide
  Seed: RLTAADHRQL (CTG1B_HUMAN)
RTTAADHRQW

SEQ ID NO: 29043 - protein, 9 aa, Artificial Sequence
  Description of Artificial Sequence: Synthetic peptide
  Seed: SGPGGGAPR (CTG1B_HUMAN)
SVPGGGAPR

SEQ ID NO: 29044 - protein, 10 aa, Artificial Sequence
  Description of Artificial Sequence: Synthetic peptide
  Seed: RLTAADHRQL (CTG1B_HUMAN)
RITAADHRQF

SEQ ID NO: 29045 - protein, 10 aa, Artificial Sequence
  Description of Artificial Sequence: Synthetic peptide
  Seed: LAQPPSGQRR (CTG1B_HUMAN)
LAQPPSGQRM

SEQ ID NO: 29046 - protein, 10 aa, Artificial Sequence
  Description of Artificial Sequence: Synthetic peptide
  Seed: RASGPGGGAP (CTG1B_HUMAN)
RPSGPGGGAM

SEQ ID NO: 29047 - protein, 11 aa, Artificial Sequence
  Description of Artificial Sequence: Synthetic peptide
  Seed: GGRGPRGAGAA (CTG1B_HUMAN)
GPRGPRGAGAC

SEQ ID NO: 29048 - protein, 10 aa, Artificial Sequence
  Description of Artificial Sequence: Synthetic peptide
  Seed: LLEFYLAMPF (CTG1B_HUMAN)
LSEFYLAMPL

SEQ ID NO: 29049 - protein, 10 aa, Artificial Sequence
  Description of Artificial Sequence: Synthetic peptide
  Seed: FTVSGNILTI (CTG1B_HUMAN)
FQVSGNILTF

SEQ ID NO: 29050 - protein, 10 aa, Artificial Sequence
  Description of Artificial Sequence: Synthetic peptide
  Seed: SRLLEFYLAM (CTG1B_HUMAN)
SQLLEFYLAA

SEQ ID NO: 29051 - protein, 10 aa, Artificial Sequence
  Description of Artificial Sequence: Synthetic peptide
  Seed: EFTVSGNILT (CTG1B_HUMAN)
EDTVSGNILI

SEQ ID NO: 29052 - protein, 8 aa, Artificial Sequence
  Description of Artificial Sequence: Synthetic peptide
  Seed: EFYLAMPF (CTG1B_HUMAN)
EMYLAMPY

SEQ ID NO: 29053 - protein, 8 aa, Artificial Sequence
  Description of Artificial Sequence: Synthetic peptide
  Seed: EFYLAMPF (CTG1B_HUMAN)
EEYLAMPL

SEQ ID NO: 29054 - protein, 11 aa, Artificial Sequence
  Description of Artificial Sequence: Synthetic peptide
  Seed: MPFATPMEAEL (CTG1B_HUMAN)
MIFATPMEAEY

SEQ ID NO: 29055 - protein, 10 aa, Artificial Sequence
  Description of Artificial Sequence: Synthetic peptide
  Seed: LSISSCLQQL (CTG1B_HUMAN)
LTISSCLQQI

SEQ ID NO: 29056 - protein, 9 aa, Artificial Sequence
  Description of Artificial Sequence: Synthetic peptide
  Seed: AQDAPPLPV (CTG1B_HUMAN)
AWDAPPLPI

SEQ ID NO: 29057 - protein, 9 aa, Artificial Sequence
  Description of Artificial Sequence: Synthetic peptide
  Seed: IPDGPGGNA (CTG1B_HUMAN)
ILDGPGGNV

SEQ ID NO: 29058 - protein, 10 aa, Artificial Sequence
  Description of Artificial Sequence: Synthetic peptide
  Seed: LAQDAPPLPV (CTG1B_HUMAN)
LAQDAPPLPY

SEQ ID NO: 29059 - protein, 9 aa, Artificial Sequence
  Description of Artificial Sequence: Synthetic peptide
  Seed: RQLQLSISS (CTG1B_HUMAN)
RTLQLSISF

SEQ ID NO: 29060 - protein, 9 aa, Artificial Sequence
  Description of Artificial Sequence: Synthetic peptide
  Seed: AQDAPPLPV (CTG1B_HUMAN)
AADAPPLPF

SEQ ID NO: 29061 - protein, 10 aa, Artificial Sequence
  Description of Artificial Sequence: Synthetic peptide
  Seed: RLLEFYLAMP (CTG1B_HUMAN)
RLLEFYLAMC

SEQ ID NO: 29062 - protein, 9 aa, Artificial Sequence
  Description of Artificial Sequence: Synthetic peptide
  Seed: SCLQQLSLL (CTG1B_HUMAN)
SALQQLSLM

SEQ ID NO: 29063 - protein, 11 aa, Artificial Sequence
  Description of Artificial Sequence: Synthetic peptide
  Seed: RLLEFYLAMPF (CTG1B_HUMAN)
RDLEFYLAMPM

SEQ ID NO: 29064 - protein, 10 aa, Artificial Sequence
  Description of Artificial Sequence: Synthetic peptide
  Seed: LEFYLAMPFA (CTG1B_HUMAN)
LQFYLAMPFA

SEQ ID NO: 29065 - protein, 10 aa, Artificial Sequence
  Description of Artificial Sequence: Synthetic peptide
  Seed: RGPESRLLEF (CTG1B_HUMAN)
RVPESRLLEM

SEQ ID NO: 29066 - protein, 9 aa, Artificial Sequence
  Description of Artificial Sequence: Synthetic peptide
  Seed: FATPMEAEL (CTG1B_HUMAN)
FHTPMEAEL

SEQ ID NO: 29067 - protein, 9 aa, Artificial Sequence
  Description of Artificial Sequence: Synthetic peptide
  Seed: IPDGPGGNA (CTG1B_HUMAN)
IMDGPGGNM

SEQ ID NO: 29068 - protein, 9 aa, Artificial Sequence
  Description of Artificial Sequence: Synthetic peptide
  Seed: AADHRQLQL (CTG1B_HUMAN)
ASDHRQLQF

SEQ ID NO: 29069 - protein, 10 aa, Artificial Sequence
  Description of Artificial Sequence: Synthetic peptide
  Seed: YLAMPFATPM (CTG1B_HUMAN)
YNAMPFATPL

SEQ ID NO: 29070 - protein, 9 aa, Artificial Sequence
  Description of Artificial Sequence: Synthetic peptide
  Seed: YLAMPFATP (CTG1B_HUMAN)
YSAMPFATA

SEQ ID NO: 29071 - protein, 11 aa, Artificial Sequence
  Description of Artificial Sequence: Synthetic peptide
  Seed: RASGPGGGAPR (CTG1B_HUMAN)
RGSGPGGGAPM

SEQ ID NO: 29072 - protein, 9 aa, Artificial Sequence
  Description of Artificial Sequence: Synthetic peptide
  Seed: LAMPFATPM (CTG1B_HUMAN)
LSMPFATPF

SEQ ID NO: 29073 - protein, 9 aa, Artificial Sequence
  Description of Artificial Sequence: Synthetic peptide
  Seed: RLLEFYLAM (CTG1B_HUMAN)
RELEFYLAL

SEQ ID NO: 29074 - protein, 9 aa, Artificial Sequence
  Description of Artificial Sequence: Synthetic peptide
  Seed: LEFYLAMPF (CTG1B_HUMAN)
LRFYLAMPY

SEQ ID NO: 29075 - protein, 9 aa, Artificial Sequence
  Description of Artificial Sequence: Synthetic peptide
  Seed: SLAQDAPPL (CTG1B_HUMAN)
SAAQDAPPM

SEQ ID NO: 29076 - protein, 9 aa, Artificial Sequence
  Description of Artificial Sequence: Synthetic peptide
  Seed: AADHRQLQL (CTG1B_HUMAN)
AEDHRQLQF

SEQ ID NO: 29077 - protein, 9 aa, Artificial Sequence
  Description of Artificial Sequence: Synthetic peptide
  Seed: AADHRQLQL (CTG1B_HUMAN)
ARDHRQLQL

SEQ ID NO: 29078 - protein, 11 aa, Artificial Sequence
  Description of Artificial Sequence: Synthetic peptide
  Seed: GPRGAGAARAS (CTG1B_HUMAN)
GPRGAGAARAF

SEQ ID NO: 29079 - protein, 9 aa, Artificial Sequence
  Description of Artificial Sequence: Synthetic peptide
  Seed: FYLAMPFAT (CTG1B_HUMAN)
FFLAMPFAY

SEQ ID NO: 29080 - protein, 11 aa, Artificial Sequence
  Description of Artificial Sequence: Synthetic peptide
  Seed: FYLAMPFATPM (CTG1B_HUMAN)
FVLAMPFATPL

SEQ ID NO: 29081 - protein, 10 aa, Artificial Sequence
  Description of Artificial Sequence: Synthetic peptide
  Seed: SRLLEFYLAM (CTG1B_HUMAN)
SFLLEFYLAV

SEQ ID NO: 29082 - protein, 9 aa, Artificial Sequence
  Description of Artificial Sequence: Synthetic peptide
  Seed: FATPMEAEL (CTG1B_HUMAN)
FPTPMEAEA

SEQ ID NO: 29083 - protein, 11 aa, Artificial Sequence
  Description of Artificial Sequence: Synthetic peptide
  Seed: RQLQLSISSCL (CTG1B_HUMAN)
RALQLSISSCY

SEQ ID NO: 29084 - protein, 9 aa, Artificial Sequence
  Description of Artificial Sequence: Synthetic peptide
  Seed: LEFYLAMPF (CTG1B_HUMAN)
LEFYLAMPY

SEQ ID NO: 29085 - protein, 10 aa, Artificial Sequence
  Description of Artificial Sequence: Synthetic peptide
  Seed: SRLLEFYLAM (CTG1B_HUMAN)
SVLLEFYLAA

SEQ ID NO: 29086 - protein, 10 aa, Artificial Sequence
  Description of Artificial Sequence: Synthetic peptide
  Seed: RGPESRLLEF (CTG1B_HUMAN)
RMPESRLLEY

SEQ ID NO: 29087 - protein, 10 aa, Artificial Sequence
  Description of Artificial Sequence: Synthetic peptide
  Seed: FLPVFLAQPP (CTG1B_HUMAN)
FCPVFLAQPI

SEQ ID NO: 29088 - protein, 9 aa, Artificial Sequence
  Description of Artificial Sequence: Synthetic peptide
  Seed: ITQCFLPVF (CTG1B_HUMAN)
IMQCFLPVM

SEQ ID NO: 29089 - protein, 9 aa, Artificial Sequence
  Description of Artificial Sequence: Synthetic peptide
  Seed: RQLQLSISS (CTG1B_HUMAN)
RILQLSISI

SEQ ID NO: 29090 - protein, 10 aa, Artificial Sequence
  Description of Artificial Sequence: Synthetic peptide
  Seed: SRLLEFYLAM (CTG1B_HUMAN)
SELLEFYLAM

SEQ ID NO: 29091 - protein, 10 aa, Artificial Sequence
  Description of Artificial Sequence: Synthetic peptide
  Seed: ASGPGGGAPR (CTG1B_HUMAN)
AVGPGGGAPR

SEQ ID NO: 29092 - protein, 10 aa, Artificial Sequence
  Description of Artificial Sequence: Synthetic peptide
  Seed: RASGPGGGAP (CTG1B_HUMAN)
RASGPGGGAM

SEQ ID NO: 29093 - protein, 9 aa, Artificial Sequence
  Description of Artificial Sequence: Synthetic peptide
  Seed: MPFATPMEA (CTG1B_HUMAN)
MMFATPMEF

SEQ ID NO: 29094 - protein, 9 aa, Artificial Sequence
  Description of Artificial Sequence: Synthetic peptide
  Seed: LAMPFATPM (CTG1B_HUMAN)
LAMPFATPY

SEQ ID NO: 29095 - protein, 9 aa, Artificial Sequence
  Description of Artificial Sequence: Synthetic peptide
  Seed: SGPGGGAPR (CTG1B_HUMAN)
SSPGGGAPV

SEQ ID NO: 29096 - protein, 11 aa, Artificial Sequence
  Description of Artificial Sequence: Synthetic peptide
  Seed: GAPRGPHGGAA (CTG1B_HUMAN)
GWPRGPHGGAL

SEQ ID NO: 29097 - protein, 10 aa, Artificial Sequence
  Description of Artificial Sequence: Synthetic peptide
  Seed: RGPRGAGAAR (CTG1B_HUMAN)
RFPRGAGAAR

SEQ ID NO: 29098 - protein, 10 aa, Artificial Sequence
  Description of Artificial Sequence: Synthetic peptide
  Seed: RLLEFYLAMP (CTG1B_HUMAN)
RQLEFYLAMA

SEQ ID NO: 29099 - protein, 11 aa, Artificial Sequence
  Description of Artificial Sequence: Synthetic peptide
  Seed: FYLAMPFATPM (CTG1B_HUMAN)
FYLAMPFATPW

SEQ ID NO: 29100 - protein, 9 aa, Artificial Sequence
  Description of Artificial Sequence: Synthetic peptide
  Seed: RQLQLSISS (CTG1B_HUMAN)
RLLQLSISY

SEQ ID NO: 29101 - protein, 10 aa, Artificial Sequence
  Description of Artificial Sequence: Synthetic peptide
  Seed: RASGPGGGAP (CTG1B_HUMAN)
RPSGPGGGAL

SEQ ID NO: 29102 - protein, 10 aa, Artificial Sequence
  Description of Artificial Sequence: Synthetic peptide
  Seed: RGPESRLLEF (CTG1B_HUMAN)
RYPESRLLEF

SEQ ID NO: 29103 - protein, 10 aa, Artificial Sequence
  Description of Artificial Sequence: Synthetic peptide
  Seed: YLAMPFATPM (CTG1B_HUMAN)
YTAMPFATPI

SEQ ID NO: 29104 - protein, 9 aa, Artificial Sequence
  Description of Artificial Sequence: Synthetic peptide
  Seed: FLPVFLAQP (CTG1B_HUMAN)
FVPVFLAQM

SEQ ID NO: 29105 - protein, 10 aa, Artificial Sequence
  Description of Artificial Sequence: Synthetic peptide
  Seed: LLEFYLAMPF (CTG1B_HUMAN)
LWEFYLAMPL

SEQ ID NO: 29106 - protein, 10 aa, Artificial Sequence
  Description of Artificial Sequence: Synthetic peptide
  Seed: RGPHGGAASG (CTG1B_HUMAN)
RQPHGGAASV

SEQ ID NO: 29107 - protein, 10 aa, Artificial Sequence
  Description of Artificial Sequence: Synthetic peptide
  Seed: RLLEFYLAMP (CTG1B_HUMAN)
RALEFYLAMV

SEQ ID NO: 29108 - protein, 9 aa, Artificial Sequence
  Description of Artificial Sequence: Synthetic peptide
  Seed: TVSGNILTI (CTG1B_HUMAN)
TMSGNILTV

SEQ ID NO: 29109 - protein, 10 aa, Artificial Sequence
  Description of Artificial Sequence: Synthetic peptide
  Seed: RSLAQDAPPL (CTG1B_HUMAN)
RMLAQDAPPV

SEQ ID NO: 29110 - protein, 10 aa, Artificial Sequence
  Description of Artificial Sequence: Synthetic peptide
  Seed: FLPVFLAQPP (CTG1B_HUMAN)
FNPVFLAQPT

SEQ ID NO: 29111 - protein, 10 aa, Artificial Sequence
  Description of Artificial Sequence: Synthetic peptide
  Seed: LLEFYLAMPF (CTG1B_HUMAN)
LYEFYLAMPW

SEQ ID NO: 29112 - protein, 9 aa, Artificial Sequence
  Description of Artificial Sequence: Synthetic peptide
  Seed: AQPPSGQRR (CTG1B_HUMAN)
ASPPSGQRM

SEQ ID NO: 29113 - protein, 10 aa, Artificial Sequence
  Description of Artificial Sequence: Synthetic peptide
  Seed: FYLAMPFATP (CTG1B_HUMAN)
FQLAMPFATI

SEQ ID NO: 29114 - protein, 10 aa, Artificial Sequence
  Description of Artificial Sequence: Synthetic peptide
  Seed: APPLPVPGVL (CTG1B_HUMAN)
APPLPVPGVA

SEQ ID NO: 29115 - protein, 9 aa, Artificial Sequence
  Description of Artificial Sequence: Synthetic peptide
  Seed: AARASGPGG (CTG1B_HUMAN)
ATRASGPGI

SEQ ID NO: 29116 - protein, 9 aa, Artificial Sequence
  Description of Artificial Sequence: Synthetic peptide
  Seed: LPVFLAQPP (CTG1B_HUMAN)
LMVFLAQPY

SEQ ID NO: 29117 - protein, 10 aa, Artificial Sequence
  Description of Artificial Sequence: Synthetic peptide
  Seed: APPLPVPGVL (CTG1B_HUMAN)
AEPLPVPGVL

SEQ ID NO: 29118 - protein, 10 aa, Artificial Sequence
  Description of Artificial Sequence: Synthetic peptide
  Seed: ISSCLQQLSL (CTG1B_HUMAN)
IISCLQQLSW

SEQ ID NO: 29119 - protein, 10 aa, Artificial Sequence
  Description of Artificial Sequence: Synthetic peptide
  Seed: FLPVFLAQPP (CTG1B_HUMAN)
FWPVFLAQPT

SEQ ID NO: 29120 - protein, 9 aa, Artificial Sequence
  Description of Artificial Sequence: Synthetic peptide
  Seed: CLQQLSLLM (CTG1B_HUMAN)
CAQQLSLLY

SEQ ID NO: 29121 - protein, 10 aa, Artificial Sequence
  Description of Artificial Sequence: Synthetic peptide
  Seed: RLLEFYLAMP (CTG1B_HUMAN)
RTLEFYLAMV

SEQ ID NO: 29122 - protein, 10 aa, Artificial Sequence
  Description of Artificial Sequence: Synthetic peptide
  Seed: RGPHGGAASG (CTG1B_HUMAN)
RCPHGGAASA

SEQ ID NO: 29123 - protein, 10 aa, Artificial Sequence
  Description of Artificial Sequence: Synthetic peptide
  Seed: FYLAMPFATP (CTG1B_HUMAN)
FLLAMPFATL

SEQ ID NO: 29124 - protein, 9 aa, Artificial Sequence
  Description of Artificial Sequence: Synthetic peptide
  Seed: LEFYLAMPF (CTG1B_HUMAN)
LPFYLAMPH

SEQ ID NO: 29125 - protein, 9 aa, Artificial Sequence
  Description of Artificial Sequence: Synthetic peptide
  Seed: LQLSISSCL (CTG1B_HUMAN)
LHLSISSCY

SEQ ID NO: 29126 - protein, 10 aa, Artificial Sequence
  Description of Artificial Sequence: Synthetic peptide
  Seed: GIPDGPGGNA (CTG1B_HUMAN)
GMPDGPGGNM

SEQ ID NO: 29127 - protein, 9 aa, Artificial Sequence
  Description of Artificial Sequence: Synthetic peptide
  Seed: LAMPFATPM (CTG1B_HUMAN)
LKMPFATPA

SEQ ID NO: 29128 - protein, 11 aa, Artificial Sequence
  Description of Artificial Sequence: Synthetic peptide
  Seed: SLLMWITQCFL (CTG1B_HUMAN)
SQLMWITQCFV

SEQ ID NO: 29129 - protein, 9 aa, Artificial Sequence
  Description of Artificial Sequence: Synthetic peptide
  Seed: SISSCLQQL (CTG1B_HUMAN)
SISSCLQQF

SEQ ID NO: 29130 - protein, 9 aa, Artificial Sequence
  Description of Artificial Sequence: Synthetic peptide
  Seed: FATPMEAEL (CTG1B_HUMAN)
FMTPMEAEA

SEQ ID NO: 29131 - protein, 11 aa, Artificial Sequence
  Description of Artificial Sequence: Synthetic peptide
  Seed: SLLMWITQCFL (CTG1B_HUMAN)
SYLMWITQCFI

SEQ ID NO: 29132 - protein, 9 aa, Artificial Sequence
  Description of Artificial Sequence: Synthetic peptide
  Seed: RLLEFYLAM (CTG1B_HUMAN)
RRLEFYLAM

SEQ ID NO: 29133 - protein, 9 aa, Artificial Sequence
  Description of Artificial Sequence: Synthetic peptide
  Seed: LPVPGVLLK (CTG1B_HUMAN)
LPVPGVLLY

SEQ ID NO: 29134 - protein, 9 aa, Artificial Sequence
  Description of Artificial Sequence: Synthetic peptide
  Seed: TAADHRQLQ (CTG1B_HUMAN)
TMADHRQLF

SEQ ID NO: 29135 - protein, 10 aa, Artificial Sequence
  Description of Artificial Sequence: Synthetic peptide
  Seed: FLAQPPSGQR (CTG1B_HUMAN)
FYAQPPSGQR

SEQ ID NO: 29136 - protein, 10 aa, Artificial Sequence
  Description of Artificial Sequence: Synthetic peptide
  Seed: RGPHGGAASG (CTG1B_HUMAN)
RDPHGGAASA

SEQ ID NO: 29137 - protein, 10 aa, Artificial Sequence
  Description of Artificial Sequence: Synthetic peptide
  Seed: GAPRGPHGGA (CTG1B_HUMAN)
GIPRGPHGGL

SEQ ID NO: 29138 - protein, 9 aa, Artificial Sequence
  Description of Artificial Sequence: Synthetic peptide
  Seed: LAMPFATPM (CTG1B_HUMAN)
LMMPFATPC

SEQ ID NO: 29139 - protein, 10 aa, Artificial Sequence
  Description of Artificial Sequence: Synthetic peptide
  Seed: LMWITQCFLP (CTG1B_HUMAN)
LLWITQCFLA

SEQ ID NO: 29140 - protein, 10 aa, Artificial Sequence
  Description of Artificial Sequence: Synthetic peptide
  Seed: FYLAMPFATP (CTG1B_HUMAN)
FMLAMPFATM

SEQ ID NO: 29141 - protein, 10 aa, Artificial Sequence
  Description of Artificial Sequence: Synthetic peptide
  Seed: ISSCLQQLSL (CTG1B_HUMAN)
ILSCLQQLSW

SEQ ID NO: 29142 - protein, 11 aa, Artificial Sequence
  Description of Artificial Sequence: Synthetic peptide
  Seed: RASGPGGGAPR (CTG1B_HUMAN)
RLSGPGGGAPY

SEQ ID NO: 29143 - protein, 9 aa, Artificial Sequence
  Description of Artificial Sequence: Synthetic peptide
  Seed: LQLSISSCL (CTG1B_HUMAN)
LILSISSCY

SEQ ID NO: 29144 - protein, 11 aa, Artificial Sequence
  Description of Artificial Sequence: Synthetic peptide
  Seed: LLMWITQCFLP (CTG1B_HUMAN)
LYMWITQCFLV

SEQ ID NO: 29145 - protein, 9 aa, Artificial Sequence
  Description of Artificial Sequence: Synthetic peptide
  Seed: FATPMEAEL (CTG1B_HUMAN)
FLTPMEAEF

SEQ ID NO: 29146 - protein, 10 aa, Artificial Sequence
  Description of Artificial Sequence: Synthetic peptide
  Seed: LLMWITQCFL (CTG1B_HUMAN)
LLMWITQCFI

SEQ ID NO: 29147 - protein, 10 aa, Artificial Sequence
  Description of Artificial Sequence: Synthetic peptide
  Seed: APPLPVPGVL (CTG1B_HUMAN)
AFPLPVPGVL

SEQ ID NO: 29148 - protein, 9 aa, Artificial Sequence
  Description of Artificial Sequence: Synthetic peptide
  Seed: FATPMEAEL (CTG1B_HUMAN)
FTTPMEAEF

SEQ ID NO: 29149 - protein, 9 aa, Artificial Sequence
  Description of Artificial Sequence: Synthetic peptide
  Seed: LLMWITQCF (CTG1B_HUMAN)
LPMWITQCI

SEQ ID NO: 29150 - protein, 10 aa, Artificial Sequence
  Description of Artificial Sequence: Synthetic peptide
  Seed: MPFATPMEAE (CTG1B_HUMAN)
MIFATPMEAM

SEQ ID NO: 29151 - protein, 11 aa, Artificial Sequence
  Description of Artificial Sequence: Synthetic peptide
  Seed: RLLEFYLAMPF (CTG1B_HUMAN)
RQLEFYLAMPM

SEQ ID NO: 29152 - protein, 9 aa, Artificial Sequence
  Description of Artificial Sequence: Synthetic peptide
  Seed: RQLQLSISS (CTG1B_HUMAN)
RSLQLSISF

SEQ ID NO: 29153 - protein, 9 aa, Artificial Sequence
  Description of Artificial Sequence: Synthetic peptide
  Seed: SLAQDAPPL (CTG1B_HUMAN)
SLAQDAPPY

SEQ ID NO: 29154 - protein, 11 aa, Artificial Sequence
  Description of Artificial Sequence: Synthetic peptide
  Seed: GAPRGPHGGAA (CTG1B_HUMAN)
GYPRGPHGGAM

SEQ ID NO: 29155 - protein, 10 aa, Artificial Sequence
  Description of Artificial Sequence: Synthetic peptide
  Seed: MWITQCFLPV (CTG1B_HUMAN)
MVITQCFLPV

SEQ ID NO: 29156 - protein, 10 aa, Artificial Sequence
  Description of Artificial Sequence: Synthetic peptide
  Seed: KEFTVSGNIL (CTG1B_HUMAN)
KEFTVSGNIF

SEQ ID NO: 29157 - protein, 9 aa, Artificial Sequence
  Description of Artificial Sequence: Synthetic peptide
  Seed: AQPPSGQRR (CTG1B_HUMAN)
ASPPSGQRL

SEQ ID NO: 29158 - protein, 9 aa, Artificial Sequence
  Description of Artificial Sequence: Synthetic peptide
  Seed: FATPMEAEL (CTG1B_HUMAN)
FRTPMEAEI

SEQ ID NO: 29159 - protein, 10 aa, Artificial Sequence
  Description of Artificial Sequence: Synthetic peptide
  Seed: YLAMPFATPM (CTG1B_HUMAN)
YGAMPFATPW

SEQ ID NO: 29160 - protein, 9 aa, Artificial Sequence
  Description of Artificial Sequence: Synthetic peptide
  Seed: CGARGPESR (CTG1B_HUMAN)
CAARGPESM

SEQ ID NO: 29161 - protein, 10 aa, Artificial Sequence
  Description of Artificial Sequence: Synthetic peptide
  Seed: FTVSGNILTI (CTG1B_HUMAN)
FVVSGNILTL

SEQ ID NO: 29162 - protein, 9 aa, Artificial Sequence
  Description of Artificial Sequence: Synthetic peptide
  Seed: LAMPFATPM (CTG1B_HUMAN)
LHMPFATPV

SEQ ID NO: 29163 - protein, 9 aa, Artificial Sequence
  Description of Artificial Sequence: Synthetic peptide
  Seed: FTVSGNILT (CTG1B_HUMAN)
FAVSGNILL

SEQ ID NO: 29164 - protein, 9 aa, Artificial Sequence
  Description of Artificial Sequence: Synthetic peptide
  Seed: ASGPGGGAP (CTG1B_HUMAN)
ATGPGGGAL

SEQ ID NO: 29165 - protein, 11 aa, Artificial Sequence
  Description of Artificial Sequence: Synthetic peptide
  Seed: GEAGATGGRGP (CTG1B_HUMAN)
GEAGATGGRGC

SEQ ID NO: 29166 - protein, 9 aa, Artificial Sequence
  Description of Artificial Sequence: Synthetic peptide
  Seed: TVSGNILTI (CTG1B_HUMAN)
TLSGNILTI

SEQ ID NO: 29167 - protein, 8 aa, Artificial Sequence
  Description of Artificial Sequence: Synthetic peptide
  Seed: EFYLAMPF (CTG1B_HUMAN)
EEYLAMPM

SEQ ID NO: 29168 - protein, 9 aa, Artificial Sequence
  Description of Artificial Sequence: Synthetic peptide
  Seed: AARASGPGG (CTG1B_HUMAN)
ATRASGPGM

SEQ ID NO: 29169 - protein, 10 aa, Artificial Sequence
  Description of Artificial Sequence: Synthetic peptide
  Seed: APPLPVPGVL (CTG1B_HUMAN)
AAPLPVPGVL

SEQ ID NO: 29170 - protein, 9 aa, Artificial Sequence
  Description of Artificial Sequence: Synthetic peptide
  Seed: SISSCLQQL (CTG1B_HUMAN)
SRSSCLQQL

SEQ ID NO: 29171 - protein, 10 aa, Artificial Sequence
  Description of Artificial Sequence: Synthetic peptide
  Seed: RLLEFYLAMP (CTG1B_HUMAN)
RQLEFYLAMM

SEQ ID NO: 29172 - protein, 10 aa, Artificial Sequence
  Description of Artificial Sequence: Synthetic peptide
  Seed: FTVSGNILTI (CTG1B_HUMAN)
FLVSGNILTT

SEQ ID NO: 29173 - protein, 9 aa, Artificial Sequence
  Description of Artificial Sequence: Synthetic peptide
  Seed: SISSCLQQL (CTG1B_HUMAN)
SMSSCLQQM

SEQ ID NO: 29174 - protein, 9 aa, Artificial Sequence
  Description of Artificial Sequence: Synthetic peptide
  Seed: LTAADHRQL (CTG1B_HUMAN)
LGAADHRQW

SEQ ID NO: 29175 - protein, 10 aa, Artificial Sequence
  Description of Artificial Sequence: Synthetic peptide
  Seed: LSISSCLQQL (CTG1B_HUMAN)
LQISSCLQQI

SEQ ID NO: 29176 - protein, 9 aa, Artificial Sequence
  Description of Artificial Sequence: Synthetic peptide
  Seed: LAMPFATPM (CTG1B_HUMAN)
LQMPFATPT

SEQ ID NO: 29177 - protein, 9 aa, Artificial Sequence
  Description of Artificial Sequence: Synthetic peptide
  Seed: LAMPFATPM (CTG1B_HUMAN)
LQMPFATPS

SEQ ID NO: 29178 - protein, 9 aa, Artificial Sequence
  Description of Artificial Sequence: Synthetic peptide
  Seed: FLPVFLAQP (CTG1B_HUMAN)
FMPVFLAQS

SEQ ID NO: 29179 - protein, 9 aa, Artificial Sequence
  Description of Artificial Sequence: Synthetic peptide
  Seed: LPVPGVLLK (CTG1B_HUMAN)
LSVPGVLLK

SEQ ID NO: 29180 - protein, 10 aa, Artificial Sequence
  Description of Artificial Sequence: Synthetic peptide
  Seed: EFTVSGNILT (CTG1B_HUMAN)
EATVSGNILI

SEQ ID NO: 29181 - protein, 9 aa, Artificial Sequence
  Description of Artificial Sequence: Synthetic peptide
  Seed: LQLSISSCL (CTG1B_HUMAN)
LLLSISSCI

SEQ ID NO: 29182 - protein, 9 aa, Artificial Sequence
  Description of Artificial Sequence: Synthetic peptide
  Seed: AADHRQLQL (CTG1B_HUMAN)
AMDHRQLQI

SEQ ID NO: 29183 - protein, 9 aa, Artificial Sequence
  Description of Artificial Sequence: Synthetic peptide
  Seed: TVSGNILTI (CTG1B_HUMAN)
TPSGNILTY

SEQ ID NO: 29184 - protein, 10 aa, Artificial Sequence
  Description of Artificial Sequence: Synthetic peptide
  Seed: RGPHGGAASG (CTG1B_HUMAN)
RYPHGGAASM

SEQ ID NO: 29185 - protein, 9 aa, Artificial Sequence
  Description of Artificial Sequence: Synthetic peptide
  Seed: LQLSISSCL (CTG1B_HUMAN)
LMLSISSCF

SEQ ID NO: 29186 - protein, 10 aa, Artificial Sequence
  Description of Artificial Sequence: Synthetic peptide
  Seed: RSLAQDAPPL (CTG1B_HUMAN)
RLLAQDAPPL

SEQ ID NO: 29187 - protein, 9 aa, Artificial Sequence
  Description of Artificial Sequence: Synthetic peptide
  Seed: SGPGGGAPR (CTG1B_HUMAN)
STPGGGAPR

SEQ ID NO: 29188 - protein, 10 aa, Artificial Sequence
  Description of Artificial Sequence: Synthetic peptide
  Seed: LLEFYLAMPF (CTG1B_HUMAN)
LFEFYLAMPF

SEQ ID NO: 29189 - protein, 10 aa, Artificial Sequence
  Description of Artificial Sequence: Synthetic peptide
  Seed: YLAMPFATPM (CTG1B_HUMAN)
YGAMPFATPI

SEQ ID NO: 29190 - protein, 10 aa, Artificial Sequence
  Description of Artificial Sequence: Synthetic peptide
  Seed: APRGPHGGAA (CTG1B_HUMAN)
APRGPHGGAP

SEQ ID NO: 29191 - protein, 10 aa, Artificial Sequence
  Description of Artificial Sequence: Synthetic peptide
  Seed: AGATGGRGPR (CTG1B_HUMAN)
ATATGGRGPK

SEQ ID NO: 29192 - protein, 9 aa, Artificial Sequence
  Description of Artificial Sequence: Synthetic peptide
  Seed: RLLEFYLAM (CTG1B_HUMAN)
RLLEFYLAK

SEQ ID NO: 29193 - protein, 10 aa, Artificial Sequence
  Description of Artificial Sequence: Synthetic peptide
  Seed: RGPHGGAASG (CTG1B_HUMAN)
RMPHGGAASF

SEQ ID NO: 29194 - protein, 9 aa, Artificial Sequence
  Description of Artificial Sequence: Synthetic peptide
  Seed: LPVFLAQPP (CTG1B_HUMAN)
LSVFLAQPY

SEQ ID NO: 29195 - protein, 10 aa, Artificial Sequence
  Description of Artificial Sequence: Synthetic peptide
  Seed: RSLAQDAPPL (CTG1B_HUMAN)
RSLAQDAPPM

SEQ ID NO: 29196 - protein, 10 aa, Artificial Sequence
  Description of Artificial Sequence: Synthetic peptide
  Seed: RSLAQDAPPL (CTG1B_HUMAN)
RVLAQDAPPW

SEQ ID NO: 29197 - protein, 10 aa, Artificial Sequence
  Description of Artificial Sequence: Synthetic peptide
  Seed: RGPHGGAASG (CTG1B_HUMAN)
RYPHGGAASL

SEQ ID NO: 29198 - protein, 9 aa, Artificial Sequence
  Description of Artificial Sequence: Synthetic peptide
  Seed: TQCFLPVFL (CTG1B_HUMAN)
TMCFLPVFM

SEQ ID NO: 29199 - protein, 10 aa, Artificial Sequence
  Description of Artificial Sequence: Synthetic peptide
  Seed: YLAMPFATPM (CTG1B_HUMAN)
YPAMPFATPT

SEQ ID NO: 29200 - protein, 10 aa, Artificial Sequence
  Description of Artificial Sequence: Synthetic peptide
  Seed: YLAMPFATPM (CTG1B_HUMAN)
YYAMPFATPF

SEQ ID NO: 29201 - protein, 9 aa, Artificial Sequence
  Description of Artificial Sequence: Synthetic peptide
  Seed: LAMPFATPM (CTG1B_HUMAN)
LRMPFATPW

SEQ ID NO: 29202 - protein, 9 aa, Artificial Sequence
  Description of Artificial Sequence: Synthetic peptide
  Seed: AADHRQLQL (CTG1B_HUMAN)
AMDHRQLQM

SEQ ID NO: 29203 - protein, 10 aa, Artificial Sequence
  Description of Artificial Sequence: Synthetic peptide
  Seed: RGPESRLLEF (CTG1B_HUMAN)
RTPESRLLEF

SEQ ID NO: 29204 - protein, 10 aa, Artificial Sequence
  Description of Artificial Sequence: Synthetic peptide
  Seed: MPFATPMEAE (CTG1B_HUMAN)
MAFATPMEAL

SEQ ID NO: 29205 - protein, 10 aa, Artificial Sequence
  Description of Artificial Sequence: Synthetic peptide
  Seed: EFTVSGNILT (CTG1B_HUMAN)
EMTVSGNILI

SEQ ID NO: 29206 - protein, 10 aa, Artificial Sequence
  Description of Artificial Sequence: Synthetic peptide
  Seed: RGPHGGAASG (CTG1B_HUMAN)
RKPHGGAASL

SEQ ID NO: 29207 - protein, 10 aa, Artificial Sequence
  Description of Artificial Sequence: Synthetic peptide
  Seed: YLAMPFATPM (CTG1B_HUMAN)
YPAMPFATPV

SEQ ID NO: 29208 - protein, 9 aa, Artificial Sequence
  Description of Artificial Sequence: Synthetic peptide
  Seed: SGPGGGAPR (CTG1B_HUMAN)
SAPGGGAPV

SEQ ID NO: 29209 - protein, 10 aa, Artificial Sequence
  Description of Artificial Sequence: Synthetic peptide
  Seed: LLEFYLAMPF (CTG1B_HUMAN)
LTEFYLAMPY

SEQ ID NO: 29210 - protein, 9 aa, Artificial Sequence
  Description of Artificial Sequence: Synthetic peptide
  Seed: TAADHRQLQ (CTG1B_HUMAN)
TSADHRQLL

SEQ ID NO: 29211 - protein, 9 aa, Artificial Sequence
  Description of Artificial Sequence: Synthetic peptide
  Seed: APPLPVPGV (CTG1B_HUMAN)
APPLPVPGT

SEQ ID NO: 29212 - protein, 9 aa, Artificial Sequence
  Description of Artificial Sequence: Synthetic peptide
  Seed: LAMPFATPM (CTG1B_HUMAN)
LQMPFATPL

SEQ ID NO: 29213 - protein, 10 aa, Artificial Sequence
  Description of Artificial Sequence: Synthetic peptide
  Seed: LEFYLAMPFA (CTG1B_HUMAN)
LQFYLAMPFC

SEQ ID NO: 29214 - protein, 9 aa, Artificial Sequence
  Description of Artificial Sequence: Synthetic peptide
  Seed: LLMWITQCF (CTG1B_HUMAN)
LYMWITQCF

SEQ ID NO: 29215 - protein, 9 aa, Artificial Sequence
  Description of Artificial Sequence: Synthetic peptide
  Seed: RQLQLSISS (CTG1B_HUMAN)
RTLQLSISY

SEQ ID NO: 29216 - protein, 11 aa, Artificial Sequence
  Description of Artificial Sequence: Synthetic peptide
  Seed: FYLAMPFATPM (CTG1B_HUMAN)
FPLAMPFATPF

SEQ ID NO: 29217 - protein, 10 aa, Artificial Sequence
  Description of Artificial Sequence: Synthetic peptide
  Seed: YLAMPFATPM (CTG1B_HUMAN)
YAAMPFATPY

SEQ ID NO: 29218 - protein, 9 aa, Artificial Sequence
  Description of Artificial Sequence: Synthetic peptide
  Seed: LAMPFATPM (CTG1B_HUMAN)
LGMPFATPW

SEQ ID NO: 29219 - protein, 9 aa, Artificial Sequence
  Description of Artificial Sequence: Synthetic peptide
  Seed: WITQCFLPV (CTG1B_HUMAN)
WMTQCFLPV

SEQ ID NO: 29220 - protein, 9 aa, Artificial Sequence
  Description of Artificial Sequence: Synthetic peptide
  Seed: TPMEAELAR (CTG1B_HUMAN)
TTMEAELAY

SEQ ID NO: 29221 - protein, 10 aa, Artificial Sequence
  Description of Artificial Sequence: Synthetic peptide
  Seed: LSISSCLQQL (CTG1B_HUMAN)
LAISSCLQQW

SEQ ID NO: 29222 - protein, 10 aa, Artificial Sequence
  Description of Artificial Sequence: Synthetic peptide
  Seed: FTVSGNILTI (CTG1B_HUMAN)
FTVSGNILTM

SEQ ID NO: 29223 - protein, 11 aa, Artificial Sequence
  Description of Artificial Sequence: Synthetic peptide
  Seed: SLLMWITQCFL (CTG1B_HUMAN)
STLMWITQCFV

SEQ ID NO: 29224 - protein, 10 aa, Artificial Sequence
  Description of Artificial Sequence: Synthetic peptide
  Seed: YLAMPFATPM (CTG1B_HUMAN)
YHAMPFATPW

SEQ ID NO: 29225 - protein, 10 aa, Artificial Sequence
  Description of Artificial Sequence: Synthetic peptide
  Seed: KEFTVSGNIL (CTG1B_HUMAN)
KQFTVSGNIV

SEQ ID NO: 29226 - protein, 10 aa, Artificial Sequence
  Description of Artificial Sequence: Synthetic peptide
  Seed: LQQLSLLMWI (CTG1B_HUMAN)
LLQLSLLMWI

SEQ ID NO: 29227 - protein, 9 aa, Artificial Sequence
  Description of Artificial Sequence: Synthetic peptide
  Seed: LLMWITQCF (CTG1B_HUMAN)
LQMWITQCV

SEQ ID NO: 29228 - protein, 10 aa, Artificial Sequence
  Description of Artificial Sequence: Synthetic peptide
  Seed: FLPVFLAQPP (CTG1B_HUMAN)
FMPVFLAQPL

SEQ ID NO: 29229 - protein, 10 aa, Artificial Sequence
  Description of Artificial Sequence: Synthetic peptide
  Seed: YLAMPFATPM (CTG1B_HUMAN)
YIAMPFATPL

SEQ ID NO: 29230 - protein, 9 aa, Artificial Sequence
  Description of Artificial Sequence: Synthetic peptide
  Seed: ITQCFLPVF (CTG1B_HUMAN)
ITQCFLPVY

SEQ ID NO: 29231 - protein, 9 aa, Artificial Sequence
  Description of Artificial Sequence: Synthetic peptide
  Seed: AADHRQLQL (CTG1B_HUMAN)
AFDHRQLQM

SEQ ID NO: 29232 - protein, 10 aa, Artificial Sequence
  Description of Artificial Sequence: Synthetic peptide
  Seed: YLAMPFATPM (CTG1B_HUMAN)
YAAMPFATPV

SEQ ID NO: 29233 - protein, 9 aa, Artificial Sequence
  Description of Artificial Sequence: Synthetic peptide
  Seed: MPFATPMEA (CTG1B_HUMAN)
MHFATPMEI

SEQ ID NO: 29234 - protein, 10 aa, Artificial Sequence
  Description of Artificial Sequence: Synthetic peptide
  Seed: RGPHGGAASG (CTG1B_HUMAN)
RCPHGGAASL

SEQ ID NO: 29235 - protein, 10 aa, Artificial Sequence
  Description of Artificial Sequence: Synthetic peptide
  Seed: YLAMPFATPM (CTG1B_HUMAN)
YFAMPFATPY

SEQ ID NO: 29236 - protein, 10 aa, Artificial Sequence
  Description of Artificial Sequence: Synthetic peptide
  Seed: FYLAMPFATP (CTG1B_HUMAN)
FLLAMPFATA

SEQ ID NO: 29237 - protein, 9 aa, Artificial Sequence
  Description of Artificial Sequence: Synthetic peptide
  Seed: ITQCFLPVF (CTG1B_HUMAN)
IQQCFLPVY

SEQ ID NO: 29238 - protein, 9 aa, Artificial Sequence
  Description of Artificial Sequence: Synthetic peptide
  Seed: LAMPFATPM (CTG1B_HUMAN)
LPMPFATPA

SEQ ID NO: 29239 - protein, 9 aa, Artificial Sequence
  Description of Artificial Sequence: Synthetic peptide
  Seed: LPVPGVLLK (CTG1B_HUMAN)
LPVPGVLLH

SEQ ID NO: 29240 - protein, 9 aa, Artificial Sequence
  Description of Artificial Sequence: Synthetic peptide
  Seed: LEFYLAMPF (CTG1B_HUMAN)
LPFYLAMPV

SEQ ID NO: 29241 - protein, 10 aa, Artificial Sequence
  Description of Artificial Sequence: Synthetic peptide
  Seed: MWITQCFLPV (CTG1B_HUMAN)
MVITQCFLPI

SEQ ID NO: 29242 - protein, 10 aa, Artificial Sequence
  Description of Artificial Sequence: Synthetic peptide
  Seed: FTVSGNILTI (CTG1B_HUMAN)
FSVSGNILTM

SEQ ID NO: 29243 - protein, 9 aa, Artificial Sequence
  Description of Artificial Sequence: Synthetic peptide
  Seed: LEFYLAMPF (CTG1B_HUMAN)
LKFYLAMPI

SEQ ID NO: 29244 - protein, 9 aa, Artificial Sequence
  Description of Artificial Sequence: Synthetic peptide
  Seed: MQAEGRGTG (CTG1B_HUMAN)
MHAEGRGTF

SEQ ID NO: 29245 - protein, 9 aa, Artificial Sequence
  Description of Artificial Sequence: Synthetic peptide
  Seed: FTVSGNILT (CTG1B_HUMAN)
FAVSGNILV

SEQ ID NO: 29246 - protein, 10 aa, Artificial Sequence
  Description of Artificial Sequence: Synthetic peptide
  Seed: LLEFYLAMPF (CTG1B_HUMAN)
LCEFYLAMPW

SEQ ID NO: 29247 - protein, 10 aa, Artificial Sequence
  Description of Artificial Sequence: Synthetic peptide
  Seed: RGPHGGAASG (CTG1B_HUMAN)
RPPHGGAASV

SEQ ID NO: 29248 - protein, 10 aa, Artificial Sequence
  Description of Artificial Sequence: Synthetic peptide
  Seed: RGPESRLLEF (CTG1B_HUMAN)
RVPESRLLEW

SEQ ID NO: 29249 - protein, 10 aa, Artificial Sequence
  Description of Artificial Sequence: Synthetic peptide
  Seed: EFTVSGNILT (CTG1B_HUMAN)
EQTVSGNILI

SEQ ID NO: 29250 - protein, 10 aa, Artificial Sequence
  Description of Artificial Sequence: Synthetic peptide
  Seed: LEFYLAMPFA (CTG1B_HUMAN)
LMFYLAMPFM

SEQ ID NO: 29251 - protein, 10 aa, Artificial Sequence
  Description of Artificial Sequence: Synthetic peptide
  Seed: RLTAADHRQL (CTG1B_HUMAN)
RWTAADHRQF

SEQ ID NO: 29252 - protein, 9 aa, Artificial Sequence
  Description of Artificial Sequence: Synthetic peptide
  Seed: AQDAPPLPV (CTG1B_HUMAN)
AEDAPPLPC

SEQ ID NO: 29253 - protein, 10 aa, Artificial Sequence
  Description of Artificial Sequence: Synthetic peptide
  Seed: FYLAMPFATP (CTG1B_HUMAN)
FMLAMPFATS

SEQ ID NO: 29254 - protein, 9 aa, Artificial Sequence
  Description of Artificial Sequence: Synthetic peptide
  Seed: APPLPVPGV (CTG1B_HUMAN)
ASPLPVPGM

SEQ ID NO: 29255 - protein, 9 aa, Artificial Sequence
  Description of Artificial Sequence: Synthetic peptide
  Seed: FLPVFLAQP (CTG1B_HUMAN)
FLPVFLAQV

SEQ ID NO: 29256 - protein, 9 aa, Artificial Sequence
  Description of Artificial Sequence: Synthetic peptide
  Seed: ITQCFLPVF (CTG1B_HUMAN)
IKQCFLPVF

SEQ ID NO: 29257 - protein, 9 aa, Artificial Sequence
  Description of Artificial Sequence: Synthetic peptide
  Seed: ITQCFLPVF (CTG1B_HUMAN)
IKQCFLPVM

SEQ ID NO: 29258 - protein, 9 aa, Artificial Sequence
  Description of Artificial Sequence: Synthetic peptide
  Seed: LAMPFATPM (CTG1B_HUMAN)
LMMPFATPA

SEQ ID NO: 29259 - protein, 9 aa, Artificial Sequence
  Description of Artificial Sequence: Synthetic peptide
  Seed: TQCFLPVFL (CTG1B_HUMAN)
TLCFLPVFM

SEQ ID NO: 29260 - protein, 11 aa, Artificial Sequence
  Description of Artificial Sequence: Synthetic peptide
  Seed: RLLEFYLAMPF (CTG1B_HUMAN)
RPLEFYLAMPY

SEQ ID NO: 29261 - protein, 9 aa, Artificial Sequence
  Description of Artificial Sequence: Synthetic peptide
  Seed: GVLLKEFTV (CTG1B_HUMAN)
GMLLKEFTA

SEQ ID NO: 29262 - protein, 10 aa, Artificial Sequence
  Description of Artificial Sequence: Synthetic peptide
  Seed: ASGPGGGAPR (CTG1B_HUMAN)
AIGPGGGAPF

SEQ ID NO: 29263 - protein, 9 aa, Artificial Sequence
  Description of Artificial Sequence: Synthetic peptide
  Seed: SISSCLQQL (CTG1B_HUMAN)
STSSCLQQR

SEQ ID NO: 29264 - protein, 9 aa, Artificial Sequence
  Description of Artificial Sequence: Synthetic peptide
  Seed: SISSCLQQL (CTG1B_HUMAN)
SASSCLQQW

SEQ ID NO: 29265 - protein, 9 aa, Artificial Sequence
  Description of Artificial Sequence: Synthetic peptide
  Seed: RQLQLSISS (CTG1B_HUMAN)
RALQLSISM

SEQ ID NO: 29266 - protein, 11 aa, Artificial Sequence
  Description of Artificial Sequence: Synthetic peptide
  Seed: RQLQLSISSCL (CTG1B_HUMAN)
RILQLSISSCY

SEQ ID NO: 29267 - protein, 9 aa, Artificial Sequence
  Description of Artificial Sequence: Synthetic peptide
  Seed: AQDAPPLPV (CTG1B_HUMAN)
ATDAPPLPF

SEQ ID NO: 29268 - protein, 10 aa, Artificial Sequence
  Description of Artificial Sequence: Synthetic peptide
  Seed: SRLLEFYLAM (CTG1B_HUMAN)
SELLEFYLAV

SEQ ID NO: 29269 - protein, 11 aa, Artificial Sequence
  Description of Artificial Sequence: Synthetic peptide
  Seed: RASGPGGGAPR (CTG1B_HUMAN)
RISGPGGGAPM

SEQ ID NO: 29270 - protein, 10 aa, Artificial Sequence
  Description of Artificial Sequence: Synthetic peptide
  Seed: YLAMPFATPM (CTG1B_HUMAN)
YQAMPFATPI

SEQ ID NO: 29271 - protein, 10 aa, Artificial Sequence
  Description of Artificial Sequence: Synthetic peptide
  Seed: LEFYLAMPFA (CTG1B_HUMAN)
LQFYLAMPFE

SEQ ID NO: 29272 - protein, 9 aa, Artificial Sequence
  Description of Artificial Sequence: Synthetic peptide
  Seed: AADHRQLQL (CTG1B_HUMAN)
AADHRQLQI

SEQ ID NO: 29273 - protein, 10 aa, Artificial Sequence
  Description of Artificial Sequence: Synthetic peptide
  Seed: IPDGPGGNAG (CTG1B_HUMAN)
IPDGPGGNAY

SEQ ID NO: 29274 - protein, 9 aa, Artificial Sequence
  Description of Artificial Sequence: Synthetic peptide
  Seed: LPVPGVLLK (CTG1B_HUMAN)
LSVPGVLLF

SEQ ID NO: 29275 - protein, 9 aa, Artificial Sequence
  Description of Artificial Sequence: Synthetic peptide
  Seed: SLLMWITQC (CTG1B_HUMAN)
SLLMWITQV

SEQ ID NO: 29276 - protein, 9 aa, Artificial Sequence
  Description of Artificial Sequence: Synthetic peptide
  Seed: AARASGPGG (CTG1B_HUMAN)
ALRASGPGK

SEQ ID NO: 29277 - protein, 10 aa, Artificial Sequence
  Description of Artificial Sequence: Synthetic peptide
  Seed: LSISSCLQQL (CTG1B_HUMAN)
LTISSCLQQF

SEQ ID NO: 29278 - protein, 10 aa, Artificial Sequence
  Description of Artificial Sequence: Synthetic peptide
  Seed: FYLAMPFATP (CTG1B_HUMAN)
FRLAMPFATA

SEQ ID NO: 29279 - protein, 9 aa, Artificial Sequence
  Description of Artificial Sequence: Synthetic peptide
  Seed: RLLEFYLAM (CTG1B_HUMAN)
RLLEFYLAY

SEQ ID NO: 29280 - protein, 10 aa, Artificial Sequence
  Description of Artificial Sequence: Synthetic peptide
  Seed: LQQLSLLMWI (CTG1B_HUMAN)
LKQLSLLMWV

SEQ ID NO: 29281 - protein, 9 aa, Artificial Sequence
  Description of Artificial Sequence: Synthetic peptide
  Seed: LEFYLAMPF (CTG1B_HUMAN)
LPFYLAMPF

SEQ ID NO: 29282 - protein, 10 aa, Artificial Sequence
  Description of Artificial Sequence: Synthetic peptide
  Seed: RGPHGGAASG (CTG1B_HUMAN)
RMPHGGAASA

SEQ ID NO: 29283 - protein, 9 aa, Artificial Sequence
  Description of Artificial Sequence: Synthetic peptide
  Seed: FTVSGNILT (CTG1B_HUMAN)
FLVSGNILM

SEQ ID NO: 29284 - protein, 9 aa, Artificial Sequence
  Description of Artificial Sequence: Synthetic peptide
  Seed: MEAELARRS (CTG1B_HUMAN)
MEAELARRV

SEQ ID NO: 29285 - protein, 9 aa, Artificial Sequence
  Description of Artificial Sequence: Synthetic peptide
  Seed: AQDAPPLPV (CTG1B_HUMAN)
AFDAPPLPV

SEQ ID NO: 29286 - protein, 9 aa, Artificial Sequence
  Description of Artificial Sequence: Synthetic peptide
  Seed: IPDGPGGNA (CTG1B_HUMAN)
IADGPGGNV

SEQ ID NO: 29287 - protein, 9 aa, Artificial Sequence
  Description of Artificial Sequence: Synthetic peptide
  Seed: SLAQDAPPL (CTG1B_HUMAN)
SAAQDAPPF

SEQ ID NO: 29288 - protein, 10 aa, Artificial Sequence
  Description of Artificial Sequence: Synthetic peptide
  Seed: RASGPGGGAP (CTG1B_HUMAN)
RGSGPGGGAY

SEQ ID NO: 29289 - protein, 10 aa, Artificial Sequence
  Description of Artificial Sequence: Synthetic peptide
  Seed: AMPFATPMEA (CTG1B_HUMAN)
AWPFATPMEL

SEQ ID NO: 29290 - protein, 11 aa, Artificial Sequence
  Description of Artificial Sequence: Synthetic peptide
  Seed: RLLEFYLAMPF (CTG1B_HUMAN)
RFLEFYLAMPY

SEQ ID NO: 29291 - protein, 9 aa, Artificial Sequence
  Description of Artificial Sequence: Synthetic peptide
  Seed: TQCFLPVFL (CTG1B_HUMAN)
TVCFLPVFL

SEQ ID NO: 29292 - protein, 10 aa, Artificial Sequence
  Description of Artificial Sequence: Synthetic peptide
  Seed: FYLAMPFATP (CTG1B_HUMAN)
FPLAMPFATL

SEQ ID NO: 29293 - protein, 9 aa, Artificial Sequence
  Description of Artificial Sequence: Synthetic peptide
  Seed: VPGVLLKEF (CTG1B_HUMAN)
VPGVLLKEL

SEQ ID NO: 29294 - protein, 9 aa, Artificial Sequence
  Description of Artificial Sequence: Synthetic peptide
  Seed: PLPVPGVLL (CTG1B_HUMAN)
PAPVPGVLL

SEQ ID NO: 29295 - protein, 10 aa, Artificial Sequence
  Description of Artificial Sequence: Synthetic peptide
  Seed: LLEFYLAMPF (CTG1B_HUMAN)
LKEFYLAMPW

SEQ ID NO: 29296 - protein, 11 aa, Artificial Sequence
  Description of Artificial Sequence: Synthetic peptide
  Seed: QDAPPLPVPGV (CTG1B_HUMAN)
QEAPPLPVPGV

SEQ ID NO: 29297 - protein, 10 aa, Artificial Sequence
  Description of Artificial Sequence: Synthetic peptide
  Seed: RASGPGGGAP (CTG1B_HUMAN)
RPSGPGGGAI

SEQ ID NO: 29298 - protein, 9 aa, Artificial Sequence
  Description of Artificial Sequence: Synthetic peptide
  Seed: RQLQLSISS (CTG1B_HUMAN)
RQLQLSISI

SEQ ID NO: 29299 - protein, 9 aa, Artificial Sequence
  Description of Artificial Sequence: Synthetic peptide
  Seed: SGNILTIRL (CTG1B_HUMAN)
SRNILTIRL

SEQ ID NO: 29300 - protein, 9 aa, Artificial Sequence
  Description of Artificial Sequence: Synthetic peptide
  Seed: FATPMEAEL (CTG1B_HUMAN)
FSTPMEAEF

SEQ ID NO: 29301 - protein, 10 aa, Artificial Sequence
  Description of Artificial Sequence: Synthetic peptide
  Seed: RGPHGGAASG (CTG1B_HUMAN)
RVPHGGAASV

SEQ ID NO: 29302 - protein, 9 aa, Artificial Sequence
  Description of Artificial Sequence: Synthetic peptide
  Seed: LAMPFATPM (CTG1B_HUMAN)
LPMPFATPS

SEQ ID NO: 29303 - protein, 10 aa, Artificial Sequence
  Description of Artificial Sequence: Synthetic peptide
  Seed: FLPVFLAQPP (CTG1B_HUMAN)
FDPVFLAQPT

SEQ ID NO: 29304 - protein, 11 aa, Artificial Sequence
  Description of Artificial Sequence: Synthetic peptide
  Seed: RLLEFYLAMPF (CTG1B_HUMAN)
RGLEFYLAMPL

SEQ ID NO: 29305 - protein, 10 aa, Artificial Sequence
  Description of Artificial Sequence: Synthetic peptide
  Seed: RGPESRLLEF (CTG1B_HUMAN)
REPESRLLEM

SEQ ID NO: 29306 - protein, 9 aa, Artificial Sequence
  Description of Artificial Sequence: Synthetic peptide
  Seed: LAMPFATPM (CTG1B_HUMAN)
LQMPFATPI

SEQ ID NO: 29307 - protein, 9 aa, Artificial Sequence
  Description of Artificial Sequence: Synthetic peptide
  Seed: LEFYLAMPF (CTG1B_HUMAN)
LFFYLAMPY

SEQ ID NO: 29308 - protein, 9 aa, Artificial Sequence
  Description of Artificial Sequence: Synthetic peptide
  Seed: IPDGPGGNA (CTG1B_HUMAN)
IPDGPGGNY

SEQ ID NO: 29309 - protein, 9 aa, Artificial Sequence
  Description of Artificial Sequence: Synthetic peptide
  Seed: AARASGPGG (CTG1B_HUMAN)
ASRASGPGF

SEQ ID NO: 29310 - protein, 10 aa, Artificial Sequence
  Description of Artificial Sequence: Synthetic peptide
  Seed: GIPDGPGGNA (CTG1B_HUMAN)
GLPDGPGGNL

SEQ ID NO: 29311 - protein, 9 aa, Artificial Sequence
  Description of Artificial Sequence: Synthetic peptide
  Seed: TQCFLPVFL (CTG1B_HUMAN)
TQCFLPVFV

SEQ ID NO: 29312 - protein, 10 aa, Artificial Sequence
  Description of Artificial Sequence: Synthetic peptide
  Seed: YLAMPFATPM (CTG1B_HUMAN)
YMAMPFATPH

SEQ ID NO: 29313 - protein, 10 aa, Artificial Sequence
  Description of Artificial Sequence: Synthetic peptide
  Seed: NILTIRLTAA (CTG1B_HUMAN)
NFLTIRLTAV

SEQ ID NO: 29314 - protein, 10 aa, Artificial Sequence
  Description of Artificial Sequence: Synthetic peptide
  Seed: FLPVFLAQPP (CTG1B_HUMAN)
FYPVFLAQPT

SEQ ID NO: 29315 - protein, 9 aa, Artificial Sequence
  Description of Artificial Sequence: Synthetic peptide
  Seed: RLLEFYLAM (CTG1B_HUMAN)
RSLEFYLAV

SEQ ID NO: 29316 - protein, 10 aa, Artificial Sequence
  Description of Artificial Sequence: Synthetic peptide
  Seed: LEFYLAMPFA (CTG1B_HUMAN)
LQFYLAMPFW

SEQ ID NO: 29317 - protein, 10 aa, Artificial Sequence
  Description of Artificial Sequence: Synthetic peptide
  Seed: YLAMPFATPM (CTG1B_HUMAN)
YFAMPFATPM

SEQ ID NO: 29318 - protein, 10 aa, Artificial Sequence
  Description of Artificial Sequence: Synthetic peptide
  Seed: GIPDGPGGNA (CTG1B_HUMAN)
GVPDGPGGNL

SEQ ID NO: 29319 - protein, 11 aa, Artificial Sequence
  Description of Artificial Sequence: Synthetic peptide
  Seed: SSCLQQLSLLM (CTG1B_HUMAN)
STCLQQLSLLF

SEQ ID NO: 29320 - protein, 9 aa, Artificial Sequence
  Description of Artificial Sequence: Synthetic peptide
  Seed: AQDAPPLPV (CTG1B_HUMAN)
ANDAPPLPL

SEQ ID NO: 29321 - protein, 9 aa, Artificial Sequence
  Description of Artificial Sequence: Synthetic peptide
  Seed: TVSGNILTI (CTG1B_HUMAN)
TVSGNILTY

SEQ ID NO: 29322 - protein, 9 aa, Artificial Sequence
  Description of Artificial Sequence: Synthetic peptide
  Seed: KEFTVSGNI (CTG1B_HUMAN)
KEFTVSGNV

SEQ ID NO: 29323 - protein, 9 aa, Artificial Sequence
  Description of Artificial Sequence: Synthetic peptide
  Seed: GVLLKEFTV (CTG1B_HUMAN)
GMLLKEFTM

SEQ ID NO: 29324 - protein, 9 aa, Artificial Sequence
  Description of Artificial Sequence: Synthetic peptide
  Seed: WITQCFLPV (CTG1B_HUMAN)
WITQCFLPI

SEQ ID NO: 29325 - protein, 10 aa, Artificial Sequence
  Description of Artificial Sequence: Synthetic peptide
  Seed: LLMWITQCFL (CTG1B_HUMAN)
LFMWITQCFL

SEQ ID NO: 29326 - protein, 9 aa, Artificial Sequence
  Description of Artificial Sequence: Synthetic peptide
  Seed: RLLEFYLAM (CTG1B_HUMAN)
RSLEFYLAM

SEQ ID NO: 29327 - protein, 9 aa, Artificial Sequence
  Description of Artificial Sequence: Synthetic peptide
  Seed: FATPMEAEL (CTG1B_HUMAN)
FITPMEAEM

SEQ ID NO: 29328 - protein, 9 aa, Artificial Sequence
  Description of Artificial Sequence: Synthetic peptide
  Seed: YLAMPFATP (CTG1B_HUMAN)
YQAMPFATV

SEQ ID NO: 29329 - protein, 9 aa, Artificial Sequence
  Description of Artificial Sequence: Synthetic peptide
  Seed: LAMPFATPM (CTG1B_HUMAN)
LTMPFATPK

SEQ ID NO: 29330 - protein, 9 aa, Artificial Sequence
  Description of Artificial Sequence: Synthetic peptide
  Seed: TVSGNILTI (CTG1B_HUMAN)
TRSGNILTF

SEQ ID NO: 29331 - protein, 10 aa, Artificial Sequence
  Description of Artificial Sequence: Synthetic peptide
  Seed: RLLEFYLAMP (CTG1B_HUMAN)
RCLEFYLAMV

SEQ ID NO: 29332 - protein, 10 aa, Artificial Sequence
  Description of Artificial Sequence: Synthetic peptide
  Seed: RGPHGGAASG (CTG1B_HUMAN)
RWPHGGAASM

SEQ ID NO: 29333 - protein, 9 aa, Artificial Sequence
  Description of Artificial Sequence: Synthetic peptide
  Seed: LAMPFATPM (CTG1B_HUMAN)
LQMPFATPY

SEQ ID NO: 29334 - protein, 10 aa, Artificial Sequence
  Description of Artificial Sequence: Synthetic peptide
  Seed: RLLEFYLAMP (CTG1B_HUMAN)
RLLEFYLAMM

SEQ ID NO: 29335 - protein, 9 aa, Artificial Sequence
  Description of Artificial Sequence: Synthetic peptide
  Seed: RLLEFYLAM (CTG1B_HUMAN)
RKLEFYLAF

SEQ ID NO: 29336 - protein, 10 aa, Artificial Sequence
  Description of Artificial Sequence: Synthetic peptide
  Seed: LSISSCLQQL (CTG1B_HUMAN)
LIISSCLQQL

SEQ ID NO: 29337 - protein, 9 aa, Artificial Sequence
  Description of Artificial Sequence: Synthetic peptide
  Seed: SISSCLQQL (CTG1B_HUMAN)
SISSCLQQI

SEQ ID NO: 29338 - protein, 10 aa, Artificial Sequence
  Description of Artificial Sequence: Synthetic peptide
  Seed: KEFTVSGNIL (CTG1B_HUMAN)
KHFTVSGNIF

SEQ ID NO: 29339 - protein, 9 aa, Artificial Sequence
  Description of Artificial Sequence: Synthetic peptide
  Seed: TVSGNILTI (CTG1B_HUMAN)
TPSGNILTI

SEQ ID NO: 29340 - protein, 11 aa, Artificial Sequence
  Description of Artificial Sequence: Synthetic peptide
  Seed: YLAMPFATPME (CTG1B_HUMAN)
YAAMPFATPMV

SEQ ID NO: 29341 - protein, 10 aa, Artificial Sequence
  Description of Artificial Sequence: Synthetic peptide
  Seed: RGPHGGAASG (CTG1B_HUMAN)
RYPHGGAASF

SEQ ID NO: 29342 - protein, 10 aa, Artificial Sequence
  Description of Artificial Sequence: Synthetic peptide
  Seed: IPDGPGGNAG (CTG1B_HUMAN)
IPDGPGGNAI

SEQ ID NO: 29343 - protein, 9 aa, Artificial Sequence
  Description of Artificial Sequence: Synthetic peptide
  Seed: IPDGPGGNA (CTG1B_HUMAN)
IVDGPGGNL

SEQ ID NO: 29344 - protein, 9 aa, Artificial Sequence
  Description of Artificial Sequence: Synthetic peptide
  Seed: ITQCFLPVF (CTG1B_HUMAN)
ISQCFLPVM

SEQ ID NO: 29345 - protein, 8 aa, Artificial Sequence
  Description of Artificial Sequence: Synthetic peptide
  Seed: FTVSGNIL (CTG1B_HUMAN)
FAVSGNIY

SEQ ID NO: 29346 - protein, 9 aa, Artificial Sequence
  Description of Artificial Sequence: Synthetic peptide
  Seed: LEFYLAMPF (CTG1B_HUMAN)
LYFYLAMPF

SEQ ID NO: 29347 - protein, 10 aa, Artificial Sequence
  Description of Artificial Sequence: Synthetic peptide
  Seed: RGPHGGAASG (CTG1B_HUMAN)
RLPHGGAASM

SEQ ID NO: 29348 - protein, 9 aa, Artificial Sequence
  Description of Artificial Sequence: Synthetic peptide
  Seed: LQQLSLLMW (CTG1B_HUMAN)
LAQLSLLMF

SEQ ID NO: 29349 - protein, 9 aa, Artificial Sequence
  Description of Artificial Sequence: Synthetic peptide
  Seed: LPVFLAQPP (CTG1B_HUMAN)
LVVFLAQPM

SEQ ID NO: 29350 - protein, 9 aa, Artificial Sequence
  Description of Artificial Sequence: Synthetic peptide
  Seed: TVSGNILTI (CTG1B_HUMAN)
TQSGNILTA

SEQ ID NO: 29351 - protein, 9 aa, Artificial Sequence
  Description of Artificial Sequence: Synthetic peptide
  Seed: LAMPFATPM (CTG1B_HUMAN)
LCMPFATPF

SEQ ID NO: 29352 - protein, 10 aa, Artificial Sequence
  Description of Artificial Sequence: Synthetic peptide
  Seed: FYLAMPFATP (CTG1B_HUMAN)
FMLAMPFATT

SEQ ID NO: 29353 - protein, 10 aa, Artificial Sequence
  Description of Artificial Sequence: Synthetic peptide
  Seed: TPMEAELARR (CTG1B_HUMAN)
TIMEAELARR

SEQ ID NO: 29354 - protein, 9 aa, Artificial Sequence
  Description of Artificial Sequence: Synthetic peptide
  Seed: LAMPFATPM (CTG1B_HUMAN)
LMMPFATPW

SEQ ID NO: 29355 - protein, 11 aa, Artificial Sequence
  Description of Artificial Sequence: Synthetic peptide
  Seed: FYLAMPFATPM (CTG1B_HUMAN)
FALAMPFATPF

SEQ ID NO: 29356 - protein, 10 aa, Artificial Sequence
  Description of Artificial Sequence: Synthetic peptide
  Seed: EFTVSGNILT (CTG1B_HUMAN)
ESTVSGNILI

SEQ ID NO: 29357 - protein, 9 aa, Artificial Sequence
  Description of Artificial Sequence: Synthetic peptide
  Seed: FATPMEAEL (CTG1B_HUMAN)
FATPMEAEM

SEQ ID NO: 29358 - protein, 10 aa, Artificial Sequence
  Description of Artificial Sequence: Synthetic peptide
  Seed: FYLAMPFATP (CTG1B_HUMAN)
FRLAMPFATI

SEQ ID NO: 29359 - protein, 11 aa, Artificial Sequence
  Description of Artificial Sequence: Synthetic peptide
  Seed: AARASGPGGGA (CTG1B_HUMAN)
AARASGPGGGF

SEQ ID NO: 29360 - protein, 10 aa, Artificial Sequence
  Description of Artificial Sequence: Synthetic peptide
  Seed: GIPDGPGGNA (CTG1B_HUMAN)
GLPDGPGGNM

SEQ ID NO: 29361 - protein, 10 aa, Artificial Sequence
  Description of Artificial Sequence: Synthetic peptide
  Seed: SRLLEFYLAM (CTG1B_HUMAN)
SQLLEFYLAY

SEQ ID NO: 29362 - protein, 10 aa, Artificial Sequence
  Description of Artificial Sequence: Synthetic peptide
  Seed: AMPFATPMEA (CTG1B_HUMAN)
AFPFATPMEV

SEQ ID NO: 29363 - protein, 9 aa, Artificial Sequence
  Description of Artificial Sequence: Synthetic peptide
  Seed: LAMPFATPM (CTG1B_HUMAN)
LVMPFATPR

SEQ ID NO: 29364 - protein, 9 aa, Artificial Sequence
  Description of Artificial Sequence: Synthetic peptide
  Seed: APPLPVPGV (CTG1B_HUMAN)
ASPLPVPGL

SEQ ID NO: 29365 - protein, 10 aa, Artificial Sequence
  Description of Artificial Sequence: Synthetic peptide
  Seed: GAPRGPHGGA (CTG1B_HUMAN)
GVPRGPHGGL

SEQ ID NO: 29366 - protein, 9 aa, Artificial Sequence
  Description of Artificial Sequence: Synthetic peptide
  Seed: LAQPPSGQR (CTG1B_HUMAN)
LAQPPSGQV

SEQ ID NO: 29367 - protein, 9 aa, Artificial Sequence
  Description of Artificial Sequence: Synthetic peptide
  Seed: SLAQDAPPL (CTG1B_HUMAN)
SMAQDAPPL

SEQ ID NO: 29368 - protein, 9 aa, Artificial Sequence
  Description of Artificial Sequence: Synthetic peptide
  Seed: LPVPGVLLK (CTG1B_HUMAN)
LSVPGVLLR

SEQ ID NO: 29369 - protein, 10 aa, Artificial Sequence
  Description of Artificial Sequence: Synthetic peptide
  Seed: GAPRGPHGGA (CTG1B_HUMAN)
GYPRGPHGGL

SEQ ID NO: 29370 - protein, 9 aa, Artificial Sequence
  Description of Artificial Sequence: Synthetic peptide
  Seed: TVSGNILTI (CTG1B_HUMAN)
TASGNILTR

SEQ ID NO: 29371 - protein, 11 aa, Artificial Sequence
  Description of Artificial Sequence: Synthetic peptide
  Seed: FYLAMPFATPM (CTG1B_HUMAN)
FALAMPFATPV

SEQ ID NO: 29372 - protein, 11 aa, Artificial Sequence
  Description of Artificial Sequence: Synthetic peptide
  Seed: GAPRGPHGGAA (CTG1B_HUMAN)
GVPRGPHGGAL

SEQ ID NO: 29373 - protein, 9 aa, Artificial Sequence
  Description of Artificial Sequence: Synthetic peptide
  Seed: LAMPFATPM (CTG1B_HUMAN)
LSMPFATPR

SEQ ID NO: 29374 - protein, 9 aa, Artificial Sequence
  Description of Artificial Sequence: Synthetic peptide
  Seed: MPFATPMEA (CTG1B_HUMAN)
MEFATPMEY

SEQ ID NO: 29375 - protein, 11 aa, Artificial Sequence
  Description of Artificial Sequence: Synthetic peptide
  Seed: FYLAMPFATPM (CTG1B_HUMAN)
FGLAMPFATPY

SEQ ID NO: 29376 - protein, 10 aa, Artificial Sequence
  Description of Artificial Sequence: Synthetic peptide
  Seed: SRLLEFYLAM (CTG1B_HUMAN)
SWLLEFYLAM

SEQ ID NO: 29377 - protein, 10 aa, Artificial Sequence
  Description of Artificial Sequence: Synthetic peptide
  Seed: LLEFYLAMPF (CTG1B_HUMAN)
LVEFYLAMPF

SEQ ID NO: 29378 - protein, 10 aa, Artificial Sequence
  Description of Artificial Sequence: Synthetic peptide
  Seed: MPFATPMEAE (CTG1B_HUMAN)
MTFATPMEAF

SEQ ID NO: 29379 - protein, 9 aa, Artificial Sequence
  Description of Artificial Sequence: Synthetic peptide
  Seed: FLPVFLAQP (CTG1B_HUMAN)
FVPVFLAQI

SEQ ID NO: 29380 - protein, 9 aa, Artificial Sequence
  Description of Artificial Sequence: Synthetic peptide
  Seed: ITQCFLPVF (CTG1B_HUMAN)
ILQCFLPVF

SEQ ID NO: 29381 - protein, 9 aa, Artificial Sequence
  Description of Artificial Sequence: Synthetic peptide
  Seed: LQQLSLLMW (CTG1B_HUMAN)
LMQLSLLMF

SEQ ID NO: 29382 - protein, 11 aa, Artificial Sequence
  Description of Artificial Sequence: Synthetic peptide
  Seed: SLLMWITQCFL (CTG1B_HUMAN)
SRLMWITQCFV

SEQ ID NO: 29383 - protein, 9 aa, Artificial Sequence
  Description of Artificial Sequence: Synthetic peptide
  Seed: KEFTVSGNI (CTG1B_HUMAN)
KEFTVSGNW

SEQ ID NO: 29384 - protein, 11 aa, Artificial Sequence
  Description of Artificial Sequence: Synthetic peptide
  Seed: RASGPGGGAPR (CTG1B_HUMAN)
RSSGPGGGAPM

SEQ ID NO: 29385 - protein, 9 aa, Artificial Sequence
  Description of Artificial Sequence: Synthetic peptide
  Seed: LLMWITQCF (CTG1B_HUMAN)
LIMWITQCA

SEQ ID NO: 29386 - protein, 9 aa, Artificial Sequence
  Description of Artificial Sequence: Synthetic peptide
  Seed: FATPMEAEL (CTG1B_HUMAN)
FSTPMEAEY

SEQ ID NO: 29387 - protein, 9 aa, Artificial Sequence
  Description of Artificial Sequence: Synthetic peptide
  Seed: APPLPVPGV (CTG1B_HUMAN)
AMPLPVPGM

SEQ ID NO: 29388 - protein, 9 aa, Artificial Sequence
  Description of Artificial Sequence: Synthetic peptide
  Seed: TAADHRQLQ (CTG1B_HUMAN)
TVADHRQLM

SEQ ID NO: 29389 - protein, 9 aa, Artificial Sequence
  Description of Artificial Sequence: Synthetic peptide
  Seed: AARASGPGG (CTG1B_HUMAN)
AMRASGPGA

SEQ ID NO: 29390 - protein, 10 aa, Artificial Sequence
  Description of Artificial Sequence: Synthetic peptide
  Seed: YLAMPFATPM (CTG1B_HUMAN)
YSAMPFATPI

SEQ ID NO: 29391 - protein, 9 aa, Artificial Sequence
  Description of Artificial Sequence: Synthetic peptide
  Seed: LQQLSLLMW (CTG1B_HUMAN)
LQQLSLLML

SEQ ID NO: 29392 - protein, 9 aa, Artificial Sequence
  Description of Artificial Sequence: Synthetic peptide
  Seed: AADHRQLQL (CTG1B_HUMAN)
AEDHRQLQV

SEQ ID NO: 29393 - protein, 9 aa, Artificial Sequence
  Description of Artificial Sequence: Synthetic peptide
  Seed: LAMPFATPM (CTG1B_HUMAN)
LIMPFATPT

SEQ ID NO: 29394 - protein, 9 aa, Artificial Sequence
  Description of Artificial Sequence: Synthetic peptide
  Seed: LAQPPSGQR (CTG1B_HUMAN)
LVQPPSGQK

SEQ ID NO: 29395 - protein, 9 aa, Artificial Sequence
  Description of Artificial Sequence: Synthetic peptide
  Seed: RLLEFYLAM (CTG1B_HUMAN)
RLLEFYLAF

SEQ ID NO: 29396 - protein, 10 aa, Artificial Sequence
  Description of Artificial Sequence: Synthetic peptide
  Seed: SRLLEFYLAM (CTG1B_HUMAN)
SELLEFYLAY

SEQ ID NO: 29397 - protein, 9 aa, Artificial Sequence
  Description of Artificial Sequence: Synthetic peptide
  Seed: AQDAPPLPV (CTG1B_HUMAN)
AGDAPPLPL

SEQ ID NO: 29398 - protein, 10 aa, Artificial Sequence
  Description of Artificial Sequence: Synthetic peptide
  Seed: FTVSGNILTI (CTG1B_HUMAN)
FAVSGNILTM

SEQ ID NO: 29399 - protein, 10 aa, Artificial Sequence
  Description of Artificial Sequence: Synthetic peptide
  Seed: MEAELARRSL (CTG1B_HUMAN)
MPAELARRSL

SEQ ID NO: 29400 - protein, 11 aa, Artificial Sequence
  Description of Artificial Sequence: Synthetic peptide
  Seed: YLAMPFATPME (CTG1B_HUMAN)
YWAMPFATPMV

SEQ ID NO: 29401 - protein, 9 aa, Artificial Sequence
  Description of Artificial Sequence: Synthetic peptide
  Seed: LEFYLAMPF (CTG1B_HUMAN)
LPFYLAMPA

SEQ ID NO: 29402 - protein, 9 aa, Artificial Sequence
  Description of Artificial Sequence: Synthetic peptide
  Seed: APRGPHGGA (CTG1B_HUMAN)
APRGPHGGC

SEQ ID NO: 29403 - protein, 9 aa, Artificial Sequence
  Description of Artificial Sequence: Synthetic peptide
  Seed: LEFYLAMPF (CTG1B_HUMAN)
LMFYLAMPW

SEQ ID NO: 29404 - protein, 10 aa, Artificial Sequence
  Description of Artificial Sequence: Synthetic peptide
  Seed: LLEFYLAMPF (CTG1B_HUMAN)
LTEFYLAMPL

SEQ ID NO: 29405 - protein, 11 aa, Artificial Sequence
  Description of Artificial Sequence: Synthetic peptide
  Seed: AARASGPGGGA (CTG1B_HUMAN)
ATRASGPGGGY

SEQ ID NO: 29406 - protein, 9 aa, Artificial Sequence
  Description of Artificial Sequence: Synthetic peptide
  Seed: LAMPFATPM (CTG1B_HUMAN)
LCMPFATPM

SEQ ID NO: 29407 - protein, 10 aa, Artificial Sequence
  Description of Artificial Sequence: Synthetic peptide
  Seed: RQLQLSISSC (CTG1B_HUMAN)
RELQLSISST

SEQ ID NO: 29408 - protein, 10 aa, Artificial Sequence
  Description of Artificial Sequence: Synthetic peptide
  Seed: YLAMPFATPM (CTG1B_HUMAN)
YQAMPFATPL

SEQ ID NO: 29409 - protein, 10 aa, Artificial Sequence
  Description of Artificial Sequence: Synthetic peptide
  Seed: LLMWITQCFL (CTG1B_HUMAN)
LQMWITQCFL

SEQ ID NO: 29410 - protein, 9 aa, Artificial Sequence
  Description of Artificial Sequence: Synthetic peptide
  Seed: RASGPGGGA (CTG1B_HUMAN)
RPSGPGGGV

SEQ ID NO: 29411 - protein, 9 aa, Artificial Sequence
  Description of Artificial Sequence: Synthetic peptide
  Seed: LAMPFATPM (CTG1B_HUMAN)
LKMPFATPF

SEQ ID NO: 29412 - protein, 10 aa, Artificial Sequence
  Description of Artificial Sequence: Synthetic peptide
  Seed: RLTAADHRQL (CTG1B_HUMAN)
RQTAADHRQF

SEQ ID NO: 29413 - protein, 9 aa, Artificial Sequence
  Description of Artificial Sequence: Synthetic peptide
  Seed: FATPMEAEL (CTG1B_HUMAN)
FPTPMEAEL

SEQ ID NO: 29414 - protein, 8 aa, Artificial Sequence
  Description of Artificial Sequence: Synthetic peptide
  Seed: ADHRQLQL (CTG1B_HUMAN)
AEHRQLQI

SEQ ID NO: 29415 - protein, 10 aa, Artificial Sequence
  Description of Artificial Sequence: Synthetic peptide
  Seed: FLAQPPSGQR (CTG1B_HUMAN)
FAAQPPSGQK

SEQ ID NO: 29416 - protein, 9 aa, Artificial Sequence
  Description of Artificial Sequence: Synthetic peptide
  Seed: AADHRQLQL (CTG1B_HUMAN)
AQDHRQLQI

SEQ ID NO: 29417 - protein, 9 aa, Artificial Sequence
  Description of Artificial Sequence: Synthetic peptide
  Seed: SISSCLQQL (CTG1B_HUMAN)
SISSCLQQY

SEQ ID NO: 29418 - protein, 11 aa, Artificial Sequence
  Description of Artificial Sequence: Synthetic peptide
  Seed: RQLQLSISSCL (CTG1B_HUMAN)
RQLQLSISSCM

SEQ ID NO: 29419 - protein, 9 aa, Artificial Sequence
  Description of Artificial Sequence: Synthetic peptide
  Seed: LQLSISSCL (CTG1B_HUMAN)
LTLSISSCV

SEQ ID NO: 29420 - protein, 9 aa, Artificial Sequence
  Description of Artificial Sequence: Synthetic peptide
  Seed: LEFYLAMPF (CTG1B_HUMAN)
LDFYLAMPI

SEQ ID NO: 29421 - protein, 10 aa, Artificial Sequence
  Description of Artificial Sequence: Synthetic peptide
  Seed: FTVSGNILTI (CTG1B_HUMAN)
FTVSGNILTV

SEQ ID NO: 29422 - protein, 9 aa, Artificial Sequence
  Description of Artificial Sequence: Synthetic peptide
  Seed: LLMWITQCF (CTG1B_HUMAN)
LIMWITQCL

SEQ ID NO: 29423 - protein, 10 aa, Artificial Sequence
  Description of Artificial Sequence: Synthetic peptide
  Seed: SRLLEFYLAM (CTG1B_HUMAN)
SFLLEFYLAM

SEQ ID NO: 29424 - protein, 10 aa, Artificial Sequence
  Description of Artificial Sequence: Synthetic peptide
  Seed: YLAMPFATPM (CTG1B_HUMAN)
YVAMPFATPK

SEQ ID NO: 29425 - protein, 10 aa, Artificial Sequence
  Description of Artificial Sequence: Synthetic peptide
  Seed: LSISSCLQQL (CTG1B_HUMAN)
LLISSCLQQI

SEQ ID NO: 29426 - protein, 9 aa, Artificial Sequence
  Description of Artificial Sequence: Synthetic peptide
  Seed: LPVPGVLLK (CTG1B_HUMAN)
LTVPGVLLK

SEQ ID NO: 29427 - protein, 10 aa, Artificial Sequence
  Description of Artificial Sequence: Synthetic peptide
  Seed: RQLQLSISSC (CTG1B_HUMAN)
RELQLSISSP

SEQ ID NO: 29428 - protein, 9 aa, Artificial Sequence
  Description of Artificial Sequence: Synthetic peptide
  Seed: MPFATPMEA (CTG1B_HUMAN)
MPFATPMEP

SEQ ID NO: 29429 - protein, 10 aa, Artificial Sequence
  Description of Artificial Sequence: Synthetic peptide
  Seed: RGPHGGAASG (CTG1B_HUMAN)
RLPHGGAASI

SEQ ID NO: 29430 - protein, 9 aa, Artificial Sequence
  Description of Artificial Sequence: Synthetic peptide
  Seed: LAMPFATPM (CTG1B_HUMAN)
LYMPFATPF

SEQ ID NO: 29431 - protein, 9 aa, Artificial Sequence
  Description of Artificial Sequence: Synthetic peptide
  Seed: CLQQLSLLM (CTG1B_HUMAN)
CLQQLSLLY

SEQ ID NO: 29432 - protein, 9 aa, Artificial Sequence
  Description of Artificial Sequence: Synthetic peptide
  Seed: SLAQDAPPL (CTG1B_HUMAN)
SLAQDAPPA

SEQ ID NO: 29433 - protein, 10 aa, Artificial Sequence
  Description of Artificial Sequence: Synthetic peptide
  Seed: LSISSCLQQL (CTG1B_HUMAN)
LLISSCLQQA

SEQ ID NO: 29434 - protein, 9 aa, Artificial Sequence
  Description of Artificial Sequence: Synthetic peptide
  Seed: SLAQDAPPL (CTG1B_HUMAN)
SRAQDAPPF

SEQ ID NO: 29435 - protein, 10 aa, Artificial Sequence
  Description of Artificial Sequence: Synthetic peptide
  Seed: WITQCFLPVF (CTG1B_HUMAN)
WMTQCFLPVF

SEQ ID NO: 29436 - protein, 10 aa, Artificial Sequence
  Description of Artificial Sequence: Synthetic peptide
  Seed: MWITQCFLPV (CTG1B_HUMAN)
MQITQCFLPA

SEQ ID NO: 29437 - protein, 10 aa, Artificial Sequence
  Description of Artificial Sequence: Synthetic peptide
  Seed: KEFTVSGNIL (CTG1B_HUMAN)
KSFTVSGNIY

SEQ ID NO: 29438 - protein, 10 aa, Artificial Sequence
  Description of Artificial Sequence: Synthetic peptide
  Seed: LLEFYLAMPF (CTG1B_HUMAN)
LQEFYLAMPW

SEQ ID NO: 29439 - protein, 10 aa, Artificial Sequence
  Description of Artificial Sequence: Synthetic peptide
  Seed: LLEFYLAMPF (CTG1B_HUMAN)
LLEFYLAMPY

SEQ ID NO: 29440 - protein, 10 aa, Artificial Sequence
  Description of Artificial Sequence: Synthetic peptide
  Seed: LSISSCLQQL (CTG1B_HUMAN)
LTISSCLQQY

SEQ ID NO: 29441 - protein, 9 aa, Artificial Sequence
  Description of Artificial Sequence: Synthetic peptide
  Seed: SSCLQQLSL (CTG1B_HUMAN)
SECLQQLSL

SEQ ID NO: 29442 - protein, 9 aa, Artificial Sequence
  Description of Artificial Sequence: Synthetic peptide
  Seed: ARGPESRLL (CTG1B_HUMAN)
ARGPESRLF

SEQ ID NO: 29443 - protein, 9 aa, Artificial Sequence
  Description of Artificial Sequence: Synthetic peptide
  Seed: LLMWITQCF (CTG1B_HUMAN)
LPMWITQCL

SEQ ID NO: 29444 - protein, 9 aa, Artificial Sequence
  Description of Artificial Sequence: Synthetic peptide
  Seed: SGNILTIRL (CTG1B_HUMAN)
SANILTIRM

SEQ ID NO: 29445 - protein, 9 aa, Artificial Sequence
  Description of Artificial Sequence: Synthetic peptide
  Seed: AARASGPGG (CTG1B_HUMAN)
ATRASGPGS

SEQ ID NO: 29446 - protein, 9 aa, Artificial Sequence
  Description of Artificial Sequence: Synthetic peptide
  Seed: QDAPPLPVP (CTG1B_HUMAN)
QEAPPLPVP

SEQ ID NO: 29447 - protein, 9 aa, Artificial Sequence
  Description of Artificial Sequence: Synthetic peptide
  Seed: CLQQLSLLM (CTG1B_HUMAN)
CLQQLSLLV

SEQ ID NO: 29448 - protein, 10 aa, Artificial Sequence
  Description of Artificial Sequence: Synthetic peptide
  Seed: FTVSGNILTI (CTG1B_HUMAN)
FSVSGNILTF

SEQ ID NO: 29449 - protein, 11 aa, Artificial Sequence
  Description of Artificial Sequence: Synthetic peptide
  Seed: RASGPGGGAPR (CTG1B_HUMAN)
RMSGPGGGAPY

SEQ ID NO: 29450 - protein, 11 aa, Artificial Sequence
  Description of Artificial Sequence: Synthetic peptide
  Seed: RASGPGGGAPR (CTG1B_HUMAN)
RYSGPGGGAPY

SEQ ID NO: 29451 - protein, 9 aa, Artificial Sequence
  Description of Artificial Sequence: Synthetic peptide
  Seed: TAADHRQLQ (CTG1B_HUMAN)
TIADHRQLF

SEQ ID NO: 29452 - protein, 11 aa, Artificial Sequence
  Description of Artificial Sequence: Synthetic peptide
  Seed: RLLEFYLAMPF (CTG1B_HUMAN)
RILEFYLAMPY

SEQ ID NO: 29453 - protein, 9 aa, Artificial Sequence
  Description of Artificial Sequence: Synthetic peptide
  Seed: GARGPESRL (CTG1B_HUMAN)
GARGPESRY

SEQ ID NO: 29454 - protein, 9 aa, Artificial Sequence
  Description of Artificial Sequence: Synthetic peptide
  Seed: GPHGGAASG (CTG1B_HUMAN)
GPHGGAASF

SEQ ID NO: 29455 - protein, 9 aa, Artificial Sequence
  Description of Artificial Sequence: Synthetic peptide
  Seed: RQLQLSISS (CTG1B_HUMAN)
RALQLSISF

SEQ ID NO: 29456 - protein, 10 aa, Artificial Sequence
  Description of Artificial Sequence: Synthetic peptide
  Seed: LSISSCLQQL (CTG1B_HUMAN)
LGISSCLQQW

SEQ ID NO: 29457 - protein, 9 aa, Artificial Sequence
  Description of Artificial Sequence: Synthetic peptide
  Seed: AADHRQLQL (CTG1B_HUMAN)
AFDHRQLQF

SEQ ID NO: 29458 - protein, 9 aa, Artificial Sequence
  Description of Artificial Sequence: Synthetic peptide
  Seed: LLMWITQCF (CTG1B_HUMAN)
LQMWITQCY

SEQ ID NO: 29459 - protein, 9 aa, Artificial Sequence
  Description of Artificial Sequence: Synthetic peptide
  Seed: TVSGNILTI (CTG1B_HUMAN)
TRSGNILTV

SEQ ID NO: 29460 - protein, 9 aa, Artificial Sequence
  Description of Artificial Sequence: Synthetic peptide
  Seed: TPMEAELAR (CTG1B_HUMAN)
TPMEAELAP

SEQ ID NO: 29461 - protein, 9 aa, Artificial Sequence
  Description of Artificial Sequence: Synthetic peptide
  Seed: RLLEFYLAM (CTG1B_HUMAN)
RFLEFYLAY

SEQ ID NO: 29462 - protein, 10 aa, Artificial Sequence
  Description of Artificial Sequence: Synthetic peptide
  Seed: RLTAADHRQL (CTG1B_HUMAN)
RLTAADHRQF

SEQ ID NO: 29463 - protein, 10 aa, Artificial Sequence
  Description of Artificial Sequence: Synthetic peptide
  Seed: RLLEFYLAMP (CTG1B_HUMAN)
RTLEFYLAML

SEQ ID NO: 29464 - protein, 9 aa, Artificial Sequence
  Description of Artificial Sequence: Synthetic peptide
  Seed: AQDAPPLPV (CTG1B_HUMAN)
AVDAPPLPM

SEQ ID NO: 29465 - protein, 11 aa, Artificial Sequence
  Description of Artificial Sequence: Synthetic peptide
  Seed: FYLAMPFATPM (CTG1B_HUMAN)
FTLAMPFATPL

SEQ ID NO: 29466 - protein, 10 aa, Artificial Sequence
  Description of Artificial Sequence: Synthetic peptide
  Seed: FTVSGNILTI (CTG1B_HUMAN)
FEVSGNILTV

SEQ ID NO: 29467 - protein, 10 aa, Artificial Sequence
  Description of Artificial Sequence: Synthetic peptide
  Seed: SSCLQQLSLL (CTG1B_HUMAN)
SSCLQQLSLF

SEQ ID NO: 29468 - protein, 11 aa, Artificial Sequence
  Description of Artificial Sequence: Synthetic peptide
  Seed: YLAMPFATPME (CTG1B_HUMAN)
YAAMPFATPMM

SEQ ID NO: 29469 - protein, 10 aa, Artificial Sequence
  Description of Artificial Sequence: Synthetic peptide
  Seed: TVSGNILTIR (CTG1B_HUMAN)
TISGNILTIR

SEQ ID NO: 29470 - protein, 9 aa, Artificial Sequence
  Description of Artificial Sequence: Synthetic peptide
  Seed: FATPMEAEL (CTG1B_HUMAN)
FYTPMEAEI

SEQ ID NO: 29471 - protein, 11 aa, Artificial Sequence
  Description of Artificial Sequence: Synthetic peptide
  Seed: QDAPPLPVPGV (CTG1B_HUMAN)
QEAPPLPVPGA

SEQ ID NO: 29472 - protein, 11 aa, Artificial Sequence
  Description of Artificial Sequence: Synthetic peptide
  Seed: RLLEFYLAMPF (CTG1B_HUMAN)
RFLEFYLAMPV

SEQ ID NO: 29473 - protein, 9 aa, Artificial Sequence
  Description of Artificial Sequence: Synthetic peptide
  Seed: LAMPFATPM (CTG1B_HUMAN)
LRMPFATPF

SEQ ID NO: 29474 - protein, 9 aa, Artificial Sequence
  Description of Artificial Sequence: Synthetic peptide
  Seed: LPVPGVLLK (CTG1B_HUMAN)
LVVPGVLLM

SEQ ID NO: 29475 - protein, 9 aa, Artificial Sequence
  Description of Artificial Sequence: Synthetic peptide
  Seed: TPMEAELAR (CTG1B_HUMAN)
TAMEAELAY

SEQ ID NO: 29476 - protein, 9 aa, Artificial Sequence
  Description of Artificial Sequence: Synthetic peptide
  Seed: TVSGNILTI (CTG1B_HUMAN)
TISGNILTL

SEQ ID NO: 29477 - protein, 10 aa, Artificial Sequence
  Description of Artificial Sequence: Synthetic peptide
  Seed: FTVSGNILTI (CTG1B_HUMAN)
FDVSGNILTV

SEQ ID NO: 29478 - protein, 9 aa, Artificial Sequence
  Description of Artificial Sequence: Synthetic peptide
  Seed: YLAMPFATP (CTG1B_HUMAN)
YIAMPFATV

SEQ ID NO: 29479 - protein, 10 aa, Artificial Sequence
  Description of Artificial Sequence: Synthetic peptide
  Seed: RGPHGGAASG (CTG1B_HUMAN)
RNPHGGAASA

SEQ ID NO: 29480 - protein, 9 aa, Artificial Sequence
  Description of Artificial Sequence: Synthetic peptide
  Seed: IPDGPGGNA (CTG1B_HUMAN)
ITDGPGGNM

SEQ ID NO: 29481 - protein, 9 aa, Artificial Sequence
  Description of Artificial Sequence: Synthetic peptide
  Seed: LAMPFATPM (CTG1B_HUMAN)
LMMPFATPS

SEQ ID NO: 29482 - protein, 10 aa, Artificial Sequence
  Description of Artificial Sequence: Synthetic peptide
  Seed: GIPDGPGGNA (CTG1B_HUMAN)
GSPDGPGGNM

SEQ ID NO: 29483 - protein, 10 aa, Artificial Sequence
  Description of Artificial Sequence: Synthetic peptide
  Seed: FYLAMPFATP (CTG1B_HUMAN)
FVLAMPFATT

SEQ ID NO: 29484 - protein, 9 aa, Artificial Sequence
  Description of Artificial Sequence: Synthetic peptide
  Seed: LLMWITQCF (CTG1B_HUMAN)
LHMWITQCY

SEQ ID NO: 29485 - protein, 10 aa, Artificial Sequence
  Description of Artificial Sequence: Synthetic peptide
  Seed: LLMWITQCFL (CTG1B_HUMAN)
LQMWITQCFV

SEQ ID NO: 29486 - protein, 11 aa, Artificial Sequence
  Description of Artificial Sequence: Synthetic peptide
  Seed: RLLEFYLAMPF (CTG1B_HUMAN)
RTLEFYLAMPV

SEQ ID NO: 29487 - protein, 11 aa, Artificial Sequence
  Description of Artificial Sequence: Synthetic peptide
  Seed: AARASGPGGGA (CTG1B_HUMAN)
APRASGPGGGA

SEQ ID NO: 29488 - protein, 10 aa, Artificial Sequence
  Description of Artificial Sequence: Synthetic peptide
  Seed: RGPESRLLEF (CTG1B_HUMAN)
RGPESRLLEL

SEQ ID NO: 29489 - protein, 10 aa, Artificial Sequence
  Description of Artificial Sequence: Synthetic peptide
  Seed: FLAQPPSGQR (CTG1B_HUMAN)
FIAQPPSGQL

SEQ ID NO: 29490 - protein, 11 aa, Artificial Sequence
  Description of Artificial Sequence: Synthetic peptide
  Seed: FYLAMPFATPM (CTG1B_HUMAN)
FMLAMPFATPV

SEQ ID NO: 29491 - protein, 10 aa, Artificial Sequence
  Description of Artificial Sequence: Synthetic peptide
  Seed: APPLPVPGVL (CTG1B_HUMAN)
ATPLPVPGVL

SEQ ID NO: 29492 - protein, 9 aa, Artificial Sequence
  Description of Artificial Sequence: Synthetic peptide
  Seed: ASGPGGGAP (CTG1B_HUMAN)
AIGPGGGAM

SEQ ID NO: 29493 - protein, 9 aa, Artificial Sequence
  Description of Artificial Sequence: Synthetic peptide
  Seed: RASGPGGGA (CTG1B_HUMAN)
RSSGPGGGY

SEQ ID NO: 29494 - protein, 9 aa, Artificial Sequence
  Description of Artificial Sequence: Synthetic peptide
  Seed: RLLEFYLAM (CTG1B_HUMAN)
RHLEFYLAF

SEQ ID NO: 29495 - protein, 9 aa, Artificial Sequence
  Description of Artificial Sequence: Synthetic peptide
  Seed: AQPPSGQRR (CTG1B_HUMAN)
AAPPSGQRI

SEQ ID NO: 29496 - protein, 9 aa, Artificial Sequence
  Description of Artificial Sequence: Synthetic peptide
  Seed: FLPVFLAQP (CTG1B_HUMAN)
FIPVFLAQM

SEQ ID NO: 29497 - protein, 9 aa, Artificial Sequence
  Description of Artificial Sequence: Synthetic peptide
  Seed: SLLMWITQC (CTG1B_HUMAN)
SMLMWITQM

SEQ ID NO: 29498 - protein, 9 aa, Artificial Sequence
  Description of Artificial Sequence: Synthetic peptide
  Seed: APPLPVPGV (CTG1B_HUMAN)
APPLPVPGF

SEQ ID NO: 29499 - protein, 10 aa, Artificial Sequence
  Description of Artificial Sequence: Synthetic peptide
  Seed: RLTAADHRQL (CTG1B_HUMAN)
RTTAADHRQF

SEQ ID NO: 29500 - protein, 10 aa, Artificial Sequence
  Description of Artificial Sequence: Synthetic peptide
  Seed: SRLLEFYLAM (CTG1B_HUMAN)
SMLLEFYLAY

SEQ ID NO: 29501 - protein, 10 aa, Artificial Sequence
  Description of Artificial Sequence: Synthetic peptide
  Seed: FTVSGNILTI (CTG1B_HUMAN)
FSVSGNILTI

SEQ ID NO: 29502 - protein, 10 aa, Artificial Sequence
  Description of Artificial Sequence: Synthetic peptide
  Seed: RLLEFYLAMP (CTG1B_HUMAN)
RMLEFYLAMA

SEQ ID NO: 29503 - protein, 9 aa, Artificial Sequence
  Description of Artificial Sequence: Synthetic peptide
  Seed: TPMEAELAR (CTG1B_HUMAN)
TPMEAELAM

SEQ ID NO: 29504 - protein, 9 aa, Artificial Sequence
  Description of Artificial Sequence: Synthetic peptide
  Seed: ITQCFLPVF (CTG1B_HUMAN)
IYQCFLPVM

SEQ ID NO: 29505 - protein, 9 aa, Artificial Sequence
  Description of Artificial Sequence: Synthetic peptide
  Seed: FATPMEAEL (CTG1B_HUMAN)
FITPMEAEY

SEQ ID NO: 29506 - protein, 11 aa, Artificial Sequence
  Description of Artificial Sequence: Synthetic peptide
  Seed: GPGEAGATGGR (CTG1B_HUMAN)
GAGEAGATGGF

SEQ ID NO: 29507 - protein, 10 aa, Artificial Sequence
  Description of Artificial Sequence: Synthetic peptide
  Seed: ISSCLQQLSL (CTG1B_HUMAN)
IDSCLQQLSW

SEQ ID NO: 29508 - protein, 9 aa, Artificial Sequence
  Description of Artificial Sequence: Synthetic peptide
  Seed: RLLEFYLAM (CTG1B_HUMAN)
RYLEFYLAF

SEQ ID NO: 29509 - protein, 11 aa, Artificial Sequence
  Description of Artificial Sequence: Synthetic peptide
  Seed: SCLQQLSLLMW (CTG1B_HUMAN)
STLQQLSLLMF

SEQ ID NO: 29510 - protein, 10 aa, Artificial Sequence
  Description of Artificial Sequence: Synthetic peptide
  Seed: TAADHRQLQL (CTG1B_HUMAN)
TTADHRQLQW

SEQ ID NO: 29511 - protein, 10 aa, Artificial Sequence
  Description of Artificial Sequence: Synthetic peptide
  Seed: AMPFATPMEA (CTG1B_HUMAN)
AFPFATPMEL

SEQ ID NO: 29512 - protein, 11 aa, Artificial Sequence
  Description of Artificial Sequence: Synthetic peptide
  Seed: SLLMWITQCFL (CTG1B_HUMAN)
SMLMWITQCFI

SEQ ID NO: 29513 - protein, 9 aa, Artificial Sequence
  Description of Artificial Sequence: Synthetic peptide
  Seed: APPLPVPGV (CTG1B_HUMAN)
AAPLPVPGL

SEQ ID NO: 29514 - protein, 8 aa, Artificial Sequence
  Description of Artificial Sequence: Synthetic peptide
  Seed: YLAMPFAT (CTG1B_HUMAN)
YMAMPFAL

SEQ ID NO: 29515 - protein, 9 aa, Artificial Sequence
  Description of Artificial Sequence: Synthetic peptide
  Seed: YLAMPFATP (CTG1B_HUMAN)
YTAMPFATI

SEQ ID NO: 29516 - protein, 10 aa, Artificial Sequence
  Description of Artificial Sequence: Synthetic peptide
  Seed: GLNGCCRCGA (CTG1B_HUMAN)
GLNGCCRCGV

SEQ ID NO: 29517 - protein, 10 aa, Artificial Sequence
  Description of Artificial Sequence: Synthetic peptide
  Seed: RGPHGGAASG (CTG1B_HUMAN)
RAPHGGAASI

SEQ ID NO: 29518 - protein, 11 aa, Artificial Sequence
  Description of Artificial Sequence: Synthetic peptide
  Seed: SLLMWITQCFL (CTG1B_HUMAN)
SILMWITQCFV

SEQ ID NO: 29519 - protein, 10 aa, Artificial Sequence
  Description of Artificial Sequence: Synthetic peptide
  Seed: FTVSGNILTI (CTG1B_HUMAN)
FWVSGNILTV

SEQ ID NO: 29520 - protein, 11 aa, Artificial Sequence
  Description of Artificial Sequence: Synthetic peptide
  Seed: GAPRGPHGGAA (CTG1B_HUMAN)
GHPRGPHGGAL

SEQ ID NO: 29521 - protein, 10 aa, Artificial Sequence
  Description of Artificial Sequence: Synthetic peptide
  Seed: LQQLSLLMWI (CTG1B_HUMAN)
LYQLSLLMWL

SEQ ID NO: 29522 - protein, 10 aa, Artificial Sequence
  Description of Artificial Sequence: Synthetic peptide
  Seed: RLLEFYLAMP (CTG1B_HUMAN)
RMLEFYLAMI

SEQ ID NO: 29523 - protein, 11 aa, Artificial Sequence
  Description of Artificial Sequence: Synthetic peptide
  Seed: RLLEFYLAMPF (CTG1B_HUMAN)
RVLEFYLAMPV

SEQ ID NO: 29524 - protein, 10 aa, Artificial Sequence
  Description of Artificial Sequence: Synthetic peptide
  Seed: LLMWITQCFL (CTG1B_HUMAN)
LKMWITQCFV

SEQ ID NO: 29525 - protein, 9 aa, Artificial Sequence
  Description of Artificial Sequence: Synthetic peptide
  Seed: RQLQLSISS (CTG1B_HUMAN)
RQLQLSISH

SEQ ID NO: 29526 - protein, 10 aa, Artificial Sequence
  Description of Artificial Sequence: Synthetic peptide
  Seed: LLEFYLAMPF (CTG1B_HUMAN)
LAEFYLAMPL

SEQ ID NO: 29527 - protein, 8 aa, Artificial Sequence
  Description of Artificial Sequence: Synthetic peptide
  Seed: RLLEFYLA (CTG1B_HUMAN)
RMLEFYLL

SEQ ID NO: 29528 - protein, 9 aa, Artificial Sequence
  Description of Artificial Sequence: Synthetic peptide
  Seed: MQAEGRGTG (CTG1B_HUMAN)
MAAEGRGTY

SEQ ID NO: 29529 - protein, 11 aa, Artificial Sequence
  Description of Artificial Sequence: Synthetic peptide
  Seed: RLLEFYLAMPF (CTG1B_HUMAN)
RRLEFYLAMPL

SEQ ID NO: 29530 - protein, 10 aa, Artificial Sequence
  Description of Artificial Sequence: Synthetic peptide
  Seed: FLPVFLAQPP (CTG1B_HUMAN)
FHPVFLAQPI

SEQ ID NO: 29531 - protein, 9 aa, Artificial Sequence
  Description of Artificial Sequence: Synthetic peptide
  Seed: CLQQLSLLM (CTG1B_HUMAN)
CKQQLSLLY

SEQ ID NO: 29532 - protein, 9 aa, Artificial Sequence
  Description of Artificial Sequence: Synthetic peptide
  Seed: LLKEFTVSG (CTG1B_HUMAN)
LMKEFTVSL

SEQ ID NO: 29533 - protein, 9 aa, Artificial Sequence
  Description of Artificial Sequence: Synthetic peptide
  Seed: TVSGNILTI (CTG1B_HUMAN)
TISGNILTW

SEQ ID NO: 29534 - protein, 10 aa, Artificial Sequence
  Description of Artificial Sequence: Synthetic peptide
  Seed: FLPVFLAQPP (CTG1B_HUMAN)
FKPVFLAQPV

SEQ ID NO: 29535 - protein, 9 aa, Artificial Sequence
  Description of Artificial Sequence: Synthetic peptide
  Seed: TPMEAELAR (CTG1B_HUMAN)
TVMEAELAK

SEQ ID NO: 29536 - protein, 10 aa, Artificial Sequence
  Description of Artificial Sequence: Synthetic peptide
  Seed: APPLPVPGVL (CTG1B_HUMAN)
APPLPVPGVM

SEQ ID NO: 29537 - protein, 9 aa, Artificial Sequence
  Description of Artificial Sequence: Synthetic peptide
  Seed: QQLSLLMWI (CTG1B_HUMAN)
QRLSLLMWM

SEQ ID NO: 29538 - protein, 10 aa, Artificial Sequence
  Description of Artificial Sequence: Synthetic peptide
  Seed: LQQLSLLMWI (CTG1B_HUMAN)
LMQLSLLMWA

SEQ ID NO: 29539 - protein, 10 aa, Artificial Sequence
  Description of Artificial Sequence: Synthetic peptide
  Seed: MPFATPMEAE (CTG1B_HUMAN)
MSFATPMEAF

SEQ ID NO: 29540 - protein, 11 aa, Artificial Sequence
  Description of Artificial Sequence: Synthetic peptide
  Seed: MWITQCFLPVF (CTG1B_HUMAN)
MYITQCFLPVW

SEQ ID NO: 29541 - protein, 9 aa, Artificial Sequence
  Description of Artificial Sequence: Synthetic peptide
  Seed: FATPMEAEL (CTG1B_HUMAN)
FSTPMEAEI

SEQ ID NO: 29542 - protein, 10 aa, Artificial Sequence
  Description of Artificial Sequence: Synthetic peptide
  Seed: KEFTVSGNIL (CTG1B_HUMAN)
KMFTVSGNIM

SEQ ID NO: 29543 - protein, 10 aa, Artificial Sequence
  Description of Artificial Sequence: Synthetic peptide
  Seed: ISSCLQQLSL (CTG1B_HUMAN)
IQSCLQQLSW

SEQ ID NO: 29544 - protein, 9 aa, Artificial Sequence
  Description of Artificial Sequence: Synthetic peptide
  Seed: LLMWITQCF (CTG1B_HUMAN)
LYMWITQCI

SEQ ID NO: 29545 - protein, 10 aa, Artificial Sequence
  Description of Artificial Sequence: Synthetic peptide
  Seed: QQLSLLMWIT (CTG1B_HUMAN)
QMLSLLMWIV

SEQ ID NO: 29546 - protein, 10 aa, Artificial Sequence
  Description of Artificial Sequence: Synthetic peptide
  Seed: RSLAQDAPPL (CTG1B_HUMAN)
RGLAQDAPPV

SEQ ID NO: 29547 - protein, 9 aa, Artificial Sequence
  Description of Artificial Sequence: Synthetic peptide
  Seed: YLAMPFATP (CTG1B_HUMAN)
YIAMPFATM

SEQ ID NO: 29548 - protein, 9 aa, Artificial Sequence
  Description of Artificial Sequence: Synthetic peptide
  Seed: YLAMPFATP (CTG1B_HUMAN)
YLAMPFATL

SEQ ID NO: 29549 - protein, 9 aa, Artificial Sequence
  Description of Artificial Sequence: Synthetic peptide
  Seed: AADHRQLQL (CTG1B_HUMAN)
ARDHRQLQF

SEQ ID NO: 29550 - protein, 9 aa, Artificial Sequence
  Description of Artificial Sequence: Synthetic peptide
  Seed: SGPGGGAPR (CTG1B_HUMAN)
SGPGGGAPF

SEQ ID NO: 29551 - protein, 10 aa, Artificial Sequence
  Description of Artificial Sequence: Synthetic peptide
  Seed: LLEFYLAMPF (CTG1B_HUMAN)
LCEFYLAMPF

SEQ ID NO: 29552 - protein, 9 aa, Artificial Sequence
  Description of Artificial Sequence: Synthetic peptide
  Seed: SSCLQQLSL (CTG1B_HUMAN)
SSCLQQLSY

SEQ ID NO: 29553 - protein, 9 aa, Artificial Sequence
  Description of Artificial Sequence: Synthetic peptide
  Seed: RQLQLSISS (CTG1B_HUMAN)
RILQLSISY

SEQ ID NO: 29554 - protein, 9 aa, Artificial Sequence
  Description of Artificial Sequence: Synthetic peptide
  Seed: LEFYLAMPF (CTG1B_HUMAN)
LQFYLAMPT

SEQ ID NO: 29555 - protein, 11 aa, Artificial Sequence
  Description of Artificial Sequence: Synthetic peptide
  Seed: FYLAMPFATPM (CTG1B_HUMAN)
FKLAMPFATPM

SEQ ID NO: 29556 - protein, 10 aa, Artificial Sequence
  Description of Artificial Sequence: Synthetic peptide
  Seed: LSISSCLQQL (CTG1B_HUMAN)
LVISSCLQQA

SEQ ID NO: 29557 - protein, 9 aa, Artificial Sequence
  Description of Artificial Sequence: Synthetic peptide
  Seed: VPGVLLKEF (CTG1B_HUMAN)
VPGVLLKEW

SEQ ID NO: 29558 - protein, 9 aa, Artificial Sequence
  Description of Artificial Sequence: Synthetic peptide
  Seed: ITQCFLPVF (CTG1B_HUMAN)
IAQCFLPVY

SEQ ID NO: 29559 - protein, 9 aa, Artificial Sequence
  Description of Artificial Sequence: Synthetic peptide
  Seed: AARASGPGG (CTG1B_HUMAN)
AARASGPGL

SEQ ID NO: 29560 - protein, 10 aa, Artificial Sequence
  Description of Artificial Sequence: Synthetic peptide
  Seed: RGPHGGAASG (CTG1B_HUMAN)
REPHGGAASF

SEQ ID NO: 29561 - protein, 9 aa, Artificial Sequence
  Description of Artificial Sequence: Synthetic peptide
  Seed: FTVSGNILT (CTG1B_HUMAN)
FTVSGNILI

SEQ ID NO: 29562 - protein, 9 aa, Artificial Sequence
  Description of Artificial Sequence: Synthetic peptide
  Seed: AARASGPGG (CTG1B_HUMAN)
AVRASGPGY

SEQ ID NO: 29563 - protein, 9 aa, Artificial Sequence
  Description of Artificial Sequence: Synthetic peptide
  Seed: SLAQDAPPL (CTG1B_HUMAN)
SEAQDAPPF

SEQ ID NO: 29564 - protein, 10 aa, Artificial Sequence
  Description of Artificial Sequence: Synthetic peptide
  Seed: SLLMWITQCF (CTG1B_HUMAN)
SRLMWITQCY

SEQ ID NO: 29565 - protein, 9 aa, Artificial Sequence
  Description of Artificial Sequence: Synthetic peptide
  Seed: WITQCFLPV (CTG1B_HUMAN)
WLTQCFLPL

SEQ ID NO: 29566 - protein, 9 aa, Artificial Sequence
  Description of Artificial Sequence: Synthetic peptide
  Seed: DAPPLPVPG (CTG1B_HUMAN)
DAPPLPVPI

SEQ ID NO: 29567 - protein, 10 aa, Artificial Sequence
  Description of Artificial Sequence: Synthetic peptide
  Seed: ASGPGGGAPR (CTG1B_HUMAN)
AMGPGGGAPK

SEQ ID NO: 29568 - protein, 10 aa, Artificial Sequence
  Description of Artificial Sequence: Synthetic peptide
  Seed: FTVSGNILTI (CTG1B_HUMAN)
FMVSGNILTI

SEQ ID NO: 29569 - protein, 9 aa, Artificial Sequence
  Description of Artificial Sequence: Synthetic peptide
  Seed: LEFYLAMPF (CTG1B_HUMAN)
LMFYLAMPH

SEQ ID NO: 29570 - protein, 10 aa, Artificial Sequence
  Description of Artificial Sequence: Synthetic peptide
  Seed: MEAELARRSL (CTG1B_HUMAN)
MEAELARRSY

SEQ ID NO: 29571 - protein, 10 aa, Artificial Sequence
  Description of Artificial Sequence: Synthetic peptide
  Seed: CLQQLSLLMW (CTG1B_HUMAN)
CTQQLSLLMW

SEQ ID NO: 29572 - protein, 9 aa, Artificial Sequence
  Description of Artificial Sequence: Synthetic peptide
  Seed: AADHRQLQL (CTG1B_HUMAN)
ATDHRQLQV

SEQ ID NO: 29573 - protein, 8 aa, Artificial Sequence
  Description of Artificial Sequence: Synthetic peptide
  Seed: RLLEFYLA (CTG1B_HUMAN)
RMLEFYLV

SEQ ID NO: 29574 - protein, 11 aa, Artificial Sequence
  Description of Artificial Sequence: Synthetic peptide
  Seed: RLLEFYLAMPF (CTG1B_HUMAN)
RNLEFYLAMPF

SEQ ID NO: 29575 - protein, 10 aa, Artificial Sequence
  Description of Artificial Sequence: Synthetic peptide
  Seed: SLLMWITQCF (CTG1B_HUMAN)
SQLMWITQCY

SEQ ID NO: 29576 - protein, 11 aa, Artificial Sequence
  Description of Artificial Sequence: Synthetic peptide
  Seed: GAPRGPHGGAA (CTG1B_HUMAN)
GIPRGPHGGAL

SEQ ID NO: 29577 - protein, 10 aa, Artificial Sequence
  Description of Artificial Sequence: Synthetic peptide
  Seed: YLAMPFATPM (CTG1B_HUMAN)
YMAMPFATPV

SEQ ID NO: 29578 - protein, 10 aa, Artificial Sequence
  Description of Artificial Sequence: Synthetic peptide
  Seed: FTVSGNILTI (CTG1B_HUMAN)
FSVSGNILTA

SEQ ID NO: 29579 - protein, 9 aa, Artificial Sequence
  Description of Artificial Sequence: Synthetic peptide
  Seed: AARASGPGG (CTG1B_HUMAN)
AWRASGPGK

SEQ ID NO: 29580 - protein, 11 aa, Artificial Sequence
  Description of Artificial Sequence: Synthetic peptide
  Seed: RQLQLSISSCL (CTG1B_HUMAN)
RDLQLSISSCY

SEQ ID NO: 29581 - protein, 11 aa, Artificial Sequence
  Description of Artificial Sequence: Synthetic peptide
  Seed: YLAMPFATPME (CTG1B_HUMAN)
YSAMPFATPMV

SEQ ID NO: 29582 - protein, 10 aa, Artificial Sequence
  Description of Artificial Sequence: Synthetic peptide
  Seed: LLEFYLAMPF (CTG1B_HUMAN)
LDEFYLAMPL

SEQ ID NO: 29583 - protein, 9 aa, Artificial Sequence
  Description of Artificial Sequence: Synthetic peptide
  Seed: YLAMPFATP (CTG1B_HUMAN)
YTAMPFATM

SEQ ID NO: 29584 - protein, 11 aa, Artificial Sequence
  Description of Artificial Sequence: Synthetic peptide
  Seed: LAMPFATPMEA (CTG1B_HUMAN)
LPMPFATPMEA

SEQ ID NO: 29585 - protein, 10 aa, Artificial Sequence
  Description of Artificial Sequence: Synthetic peptide
  Seed: FYLAMPFATP (CTG1B_HUMAN)
FVLAMPFATI

SEQ ID NO: 29586 - protein, 9 aa, Artificial Sequence
  Description of Artificial Sequence: Synthetic peptide
  Seed: RQLQLSISS (CTG1B_HUMAN)
RHLQLSISF

SEQ ID NO: 29587 - protein, 9 aa, Artificial Sequence
  Description of Artificial Sequence: Synthetic peptide
  Seed: QQLSLLMWI (CTG1B_HUMAN)
QLLSLLMWL

SEQ ID NO: 29588 - protein, 9 aa, Artificial Sequence
  Description of Artificial Sequence: Synthetic peptide
  Seed: FATPMEAEL (CTG1B_HUMAN)
FATPMEAEW

SEQ ID NO: 29589 - protein, 10 aa, Artificial Sequence
  Description of Artificial Sequence: Synthetic peptide
  Seed: AMPFATPMEA (CTG1B_HUMAN)
ALPFATPMEV

SEQ ID NO: 29590 - protein, 11 aa, Artificial Sequence
  Description of Artificial Sequence: Synthetic peptide
  Seed: RQLQLSISSCL (CTG1B_HUMAN)
RVLQLSISSCY

SEQ ID NO: 29591 - protein, 9 aa, Artificial Sequence
  Description of Artificial Sequence: Synthetic peptide
  Seed: AADHRQLQL (CTG1B_HUMAN)
AQDHRQLQW

SEQ ID NO: 29592 - protein, 9 aa, Artificial Sequence
  Description of Artificial Sequence: Synthetic peptide
  Seed: IPDGPGGNA (CTG1B_HUMAN)
IPDGPGGNF

SEQ ID NO: 29593 - protein, 9 aa, Artificial Sequence
  Description of Artificial Sequence: Synthetic peptide
  Seed: TVSGNILTI (CTG1B_HUMAN)
TVSGNILTM

SEQ ID NO: 29594 - protein, 10 aa, Artificial Sequence
  Description of Artificial Sequence: Synthetic peptide
  Seed: RLTAADHRQL (CTG1B_HUMAN)
RTTAADHRQY

SEQ ID NO: 29595 - protein, 9 aa, Artificial Sequence
  Description of Artificial Sequence: Synthetic peptide
  Seed: IPDGPGGNA (CTG1B_HUMAN)
ITDGPGGNF

SEQ ID NO: 29596 - protein, 9 aa, Artificial Sequence
  Description of Artificial Sequence: Synthetic peptide
  Seed: GPRGAGAAR (CTG1B_HUMAN)
GARGAGAAL

SEQ ID NO: 29597 - protein, 9 aa, Artificial Sequence
  Description of Artificial Sequence: Synthetic peptide
  Seed: GPHGGAASG (CTG1B_HUMAN)
GPHGGAASA

SEQ ID NO: 29598 - protein, 10 aa, Artificial Sequence
  Description of Artificial Sequence: Synthetic peptide
  Seed: ISSCLQQLSL (CTG1B_HUMAN)
ITSCLQQLSW

SEQ ID NO: 29599 - protein, 10 aa, Artificial Sequence
  Description of Artificial Sequence: Synthetic peptide
  Seed: LSISSCLQQL (CTG1B_HUMAN)
LAISSCLQQF

SEQ ID NO: 29600 - protein, 9 aa, Artificial Sequence
  Description of Artificial Sequence: Synthetic peptide
  Seed: LPVFLAQPP (CTG1B_HUMAN)
LVVFLAQPY

SEQ ID NO: 29601 - protein, 9 aa, Artificial Sequence
  Description of Artificial Sequence: Synthetic peptide
  Seed: AQPPSGQRR (CTG1B_HUMAN)
ATPPSGQRL

SEQ ID NO: 29602 - protein, 9 aa, Artificial Sequence
  Description of Artificial Sequence: Synthetic peptide
  Seed: FATPMEAEL (CTG1B_HUMAN)
FLTPMEAEA

SEQ ID NO: 29603 - protein, 11 aa, Artificial Sequence
  Description of Artificial Sequence: Synthetic peptide
  Seed: FLAQPPSGQRR (CTG1B_HUMAN)
FTAQPPSGQRR

SEQ ID NO: 29604 - protein, 9 aa, Artificial Sequence
  Description of Artificial Sequence: Synthetic peptide
  Seed: LQLSISSCL (CTG1B_HUMAN)
LRLSISSCY

SEQ ID NO: 29605 - protein, 10 aa, Artificial Sequence
  Description of Artificial Sequence: Synthetic peptide
  Seed: ASGPGGGAPR (CTG1B_HUMAN)
AAGPGGGAPR

SEQ ID NO: 29606 - protein, 10 aa, Artificial Sequence
  Description of Artificial Sequence: Synthetic peptide
  Seed: FLPVFLAQPP (CTG1B_HUMAN)
FTPVFLAQPT

SEQ ID NO: 29607 - protein, 9 aa, Artificial Sequence
  Description of Artificial Sequence: Synthetic peptide
  Seed: SISSCLQQL (CTG1B_HUMAN)
SSSSCLQQW

SEQ ID NO: 29608 - protein, 9 aa, Artificial Sequence
  Description of Artificial Sequence: Synthetic peptide
  Seed: FATPMEAEL (CTG1B_HUMAN)
FLTPMEAEY

SEQ ID NO: 29609 - protein, 10 aa, Artificial Sequence
  Description of Artificial Sequence: Synthetic peptide
  Seed: GAPRGPHGGA (CTG1B_HUMAN)
GFPRGPHGGM

SEQ ID NO: 29610 - protein, 10 aa, Artificial Sequence
  Description of Artificial Sequence: Synthetic peptide
  Seed: MWITQCFLPV (CTG1B_HUMAN)
MSITQCFLPV

SEQ ID NO: 29611 - protein, 9 aa, Artificial Sequence
  Description of Artificial Sequence: Synthetic peptide
  Seed: FYLAMPFAT (CTG1B_HUMAN)
FYLAMPFAF

SEQ ID NO: 29612 - protein, 11 aa, Artificial Sequence
  Description of Artificial Sequence: Synthetic peptide
  Seed: RLLEFYLAMPF (CTG1B_HUMAN)
RVLEFYLAMPY

SEQ ID NO: 29613 - protein, 9 aa, Artificial Sequence
  Description of Artificial Sequence: Synthetic peptide
  Seed: MPFATPMEA (CTG1B_HUMAN)
MTFATPMEF

SEQ ID NO: 29614 - protein, 10 aa, Artificial Sequence
  Description of Artificial Sequence: Synthetic peptide
  Seed: LEFYLAMPFA (CTG1B_HUMAN)
LEFYLAMPFL

SEQ ID NO: 29615 - protein, 9 aa, Artificial Sequence
  Description of Artificial Sequence: Synthetic peptide
  Seed: RLLEFYLAM (CTG1B_HUMAN)
RQLEFYLAH

SEQ ID NO: 29616 - protein, 10 aa, Artificial Sequence
  Description of Artificial Sequence: Synthetic peptide
  Seed: APPLPVPGVL (CTG1B_HUMAN)
ANPLPVPGVL

SEQ ID NO: 29617 - protein, 9 aa, Artificial Sequence
  Description of Artificial Sequence: Synthetic peptide
  Seed: LEFYLAMPF (CTG1B_HUMAN)
LQFYLAMPI

SEQ ID NO: 29618 - protein, 10 aa, Artificial Sequence
  Description of Artificial Sequence: Synthetic peptide
  Seed: RLTAADHRQL (CTG1B_HUMAN)
RSTAADHRQW

SEQ ID NO: 29619 - protein, 10 aa, Artificial Sequence
  Description of Artificial Sequence: Synthetic peptide
  Seed: MWITQCFLPV (CTG1B_HUMAN)
MTITQCFLPI

SEQ ID NO: 29620 - protein, 9 aa, Artificial Sequence
  Description of Artificial Sequence: Synthetic peptide
  Seed: TVSGNILTI (CTG1B_HUMAN)
TRSGNILTY

SEQ ID NO: 29621 - protein, 10 aa, Artificial Sequence
  Description of Artificial Sequence: Synthetic peptide
  Seed: LLEFYLAMPF (CTG1B_HUMAN)
LVEFYLAMPY

SEQ ID NO: 29622 - protein, 9 aa, Artificial Sequence
  Description of Artificial Sequence: Synthetic peptide
  Seed: ILTIRLTAA (CTG1B_HUMAN)
IPTIRLTAI

SEQ ID NO: 29623 - protein, 10 aa, Artificial Sequence
  Description of Artificial Sequence: Synthetic peptide
  Seed: LLEFYLAMPF (CTG1B_HUMAN)
LLEFYLAMPW

SEQ ID NO: 29624 - protein, 11 aa, Artificial Sequence
  Description of Artificial Sequence: Synthetic peptide
  Seed: MPFATPMEAEL (CTG1B_HUMAN)
MAFATPMEAEM

SEQ ID NO: 29625 - protein, 11 aa, Artificial Sequence
  Description of Artificial Sequence: Synthetic peptide
  Seed: RASGPGGGAPR (CTG1B_HUMAN)
RSSGPGGGAPH

SEQ ID NO: 29626 - protein, 10 aa, Artificial Sequence
  Description of Artificial Sequence: Synthetic peptide
  Seed: FLPVFLAQPP (CTG1B_HUMAN)
FCPVFLAQPV

SEQ ID NO: 29627 - protein, 9 aa, Artificial Sequence
  Description of Artificial Sequence: Synthetic peptide
  Seed: LAMPFATPM (CTG1B_HUMAN)
LFMPFATPY

SEQ ID NO: 29628 - protein, 10 aa, Artificial Sequence
  Description of Artificial Sequence: Synthetic peptide
  Seed: RGPHGGAASG (CTG1B_HUMAN)
RRPHGGAASL

SEQ ID NO: 29629 - protein, 9 aa, Artificial Sequence
  Description of Artificial Sequence: Synthetic peptide
  Seed: FATPMEAEL (CTG1B_HUMAN)
FGTPMEAEF

SEQ ID NO: 29630 - protein, 9 aa, Artificial Sequence
  Description of Artificial Sequence: Synthetic peptide
  Seed: GARGPESRL (CTG1B_HUMAN)
GMRGPESRY

SEQ ID NO: 29631 - protein, 9 aa, Artificial Sequence
  Description of Artificial Sequence: Synthetic peptide
  Seed: RLLEFYLAM (CTG1B_HUMAN)
RRLEFYLAY

SEQ ID NO: 29632 - protein, 10 aa, Artificial Sequence
  Description of Artificial Sequence: Synthetic peptide
  Seed: RSLAQDAPPL (CTG1B_HUMAN)
RMLAQDAPPL

SEQ ID NO: 29633 - protein, 9 aa, Artificial Sequence
  Description of Artificial Sequence: Synthetic peptide
  Seed: IPDGPGGNA (CTG1B_HUMAN)
INDGPGGNL

SEQ ID NO: 29634 - protein, 11 aa, Artificial Sequence
  Description of Artificial Sequence: Synthetic peptide
  Seed: FYLAMPFATPM (CTG1B_HUMAN)
FTLAMPFATPF

SEQ ID NO: 29635 - protein, 9 aa, Artificial Sequence
  Description of Artificial Sequence: Synthetic peptide
  Seed: RLLEFYLAM (CTG1B_HUMAN)
RLLEFYLAW

SEQ ID NO: 29636 - protein, 11 aa, Artificial Sequence
  Description of Artificial Sequence: Synthetic peptide
  Seed: MPFATPMEAEL (CTG1B_HUMAN)
MTFATPMEAEY

SEQ ID NO: 29637 - protein, 10 aa, Artificial Sequence
  Description of Artificial Sequence: Synthetic peptide
  Seed: WITQCFLPVF (CTG1B_HUMAN)
WQTQCFLPVM

SEQ ID NO: 29638 - protein, 10 aa, Artificial Sequence
  Description of Artificial Sequence: Synthetic peptide
  Seed: FLAQPPSGQR (CTG1B_HUMAN)
FIAQPPSGQK

SEQ ID NO: 29639 - protein, 9 aa, Artificial Sequence
  Description of Artificial Sequence: Synthetic peptide
  Seed: SLLMWITQC (CTG1B_HUMAN)
SALMWITQL

SEQ ID NO: 29640 - protein, 10 aa, Artificial Sequence
  Description of Artificial Sequence: Synthetic peptide
  Seed: QQLSLLMWIT (CTG1B_HUMAN)
QLLSLLMWIV

SEQ ID NO: 29641 - protein, 9 aa, Artificial Sequence
  Description of Artificial Sequence: Synthetic peptide
  Seed: LAMPFATPM (CTG1B_HUMAN)
LGMPFATPY

SEQ ID NO: 29642 - protein, 9 aa, Artificial Sequence
  Description of Artificial Sequence: Synthetic peptide
  Seed: FLPVFLAQP (CTG1B_HUMAN)
FIPVFLAQV

SEQ ID NO: 29643 - protein, 9 aa, Artificial Sequence
  Description of Artificial Sequence: Synthetic peptide
  Seed: SISSCLQQL (CTG1B_HUMAN)
SASSCLQQV

SEQ ID NO: 29644 - protein, 9 aa, Artificial Sequence
  Description of Artificial Sequence: Synthetic peptide
  Seed: SRLLEFYLA (CTG1B_HUMAN)
SHLLEFYLA

SEQ ID NO: 29645 - protein, 11 aa, Artificial Sequence
  Description of Artificial Sequence: Synthetic peptide
  Seed: RQLQLSISSCL (CTG1B_HUMAN)
RNLQLSISSCY

SEQ ID NO: 29646 - protein, 11 aa, Artificial Sequence
  Description of Artificial Sequence: Synthetic peptide
  Seed: GAPRGPHGGAA (CTG1B_HUMAN)
GLPRGPHGGAM

SEQ ID NO: 29647 - protein, 10 aa, Artificial Sequence
  Description of Artificial Sequence: Synthetic peptide
  Seed: TAADHRQLQL (CTG1B_HUMAN)
TAADHRQLQY

SEQ ID NO: 29648 - protein, 10 aa, Artificial Sequence
  Description of Artificial Sequence: Synthetic peptide
  Seed: FTVSGNILTI (CTG1B_HUMAN)
FQVSGNILTM

SEQ ID NO: 29649 - protein, 9 aa, Artificial Sequence
  Description of Artificial Sequence: Synthetic peptide
  Seed: LAMPFATPM (CTG1B_HUMAN)
LEMPFATPM

SEQ ID NO: 29650 - protein, 9 aa, Artificial Sequence
  Description of Artificial Sequence: Synthetic peptide
  Seed: TVSGNILTI (CTG1B_HUMAN)
TTSGNILTI

SEQ ID NO: 29651 - protein, 9 aa, Artificial Sequence
  Description of Artificial Sequence: Synthetic peptide
  Seed: MPFATPMEA (CTG1B_HUMAN)
MGFATPMEM

SEQ ID NO: 29652 - protein, 9 aa, Artificial Sequence
  Description of Artificial Sequence: Synthetic peptide
  Seed: TVSGNILTI (CTG1B_HUMAN)
TSSGNILTW

SEQ ID NO: 29653 - protein, 11 aa, Artificial Sequence
  Description of Artificial Sequence: Synthetic peptide
  Seed: RQLQLSISSCL (CTG1B_HUMAN)
RWLQLSISSCF

SEQ ID NO: 29654 - protein, 9 aa, Artificial Sequence
  Description of Artificial Sequence: Synthetic peptide
  Seed: LLMWITQCF (CTG1B_HUMAN)
LQMWITQCH

SEQ ID NO: 29655 - protein, 9 aa, Artificial Sequence
  Description of Artificial Sequence: Synthetic peptide
  Seed: SSCLQQLSL (CTG1B_HUMAN)
SVCLQQLSF

SEQ ID NO: 29656 - protein, 10 aa, Artificial Sequence
  Description of Artificial Sequence: Synthetic peptide
  Seed: TAADHRQLQL (CTG1B_HUMAN)
TSADHRQLQW

SEQ ID NO: 29657 - protein, 10 aa, Artificial Sequence
  Description of Artificial Sequence: Synthetic peptide
  Seed: FYLAMPFATP (CTG1B_HUMAN)
FFLAMPFATV

SEQ ID NO: 29658 - protein, 10 aa, Artificial Sequence
  Description of Artificial Sequence: Synthetic peptide
  Seed: GAPRGPHGGA (CTG1B_HUMAN)
GNPRGPHGGL

SEQ ID NO: 29659 - protein, 9 aa, Artificial Sequence
  Description of Artificial Sequence: Synthetic peptide
  Seed: LAMPFATPM (CTG1B_HUMAN)
LWMPFATPM

SEQ ID NO: 29660 - protein, 10 aa, Artificial Sequence
  Description of Artificial Sequence: Synthetic peptide
  Seed: RGPHGGAASG (CTG1B_HUMAN)
RAPHGGAASV

SEQ ID NO: 29661 - protein, 10 aa, Artificial Sequence
  Description of Artificial Sequence: Synthetic peptide
  Seed: ASGPGGGAPR (CTG1B_HUMAN)
AAGPGGGAPM

SEQ ID NO: 29662 - protein, 9 aa, Artificial Sequence
  Description of Artificial Sequence: Synthetic peptide
  Seed: AADHRQLQL (CTG1B_HUMAN)
AVDHRQLQI

SEQ ID NO: 29663 - protein, 9 aa, Artificial Sequence
  Description of Artificial Sequence: Synthetic peptide
  Seed: SISSCLQQL (CTG1B_HUMAN)
SRSSCLQQY

SEQ ID NO: 29664 - protein, 10 aa, Artificial Sequence
  Description of Artificial Sequence: Synthetic peptide
  Seed: SRLLEFYLAM (CTG1B_HUMAN)
SHLLEFYLAY

SEQ ID NO: 29665 - protein, 9 aa, Artificial Sequence
  Description of Artificial Sequence: Synthetic peptide
  Seed: FATPMEAEL (CTG1B_HUMAN)
FMTPMEAEY

SEQ ID NO: 29666 - protein, 10 aa, Artificial Sequence
  Description of Artificial Sequence: Synthetic peptide
  Seed: AQDAPPLPVP (CTG1B_HUMAN)
AEDAPPLPVC

SEQ ID NO: 29667 - protein, 9 aa, Artificial Sequence
  Description of Artificial Sequence: Synthetic peptide
  Seed: LAMPFATPM (CTG1B_HUMAN)
LSMPFATPK

SEQ ID NO: 29668 - protein, 9 aa, Artificial Sequence
  Description of Artificial Sequence: Synthetic peptide
  Seed: VSGNILTIR (CTG1B_HUMAN)
VTGNILTIR

SEQ ID NO: 29669 - protein, 9 aa, Artificial Sequence
  Description of Artificial Sequence: Synthetic peptide
  Seed: YLAMPFATP (CTG1B_HUMAN)
YLAMPFATV

SEQ ID NO: 29670 - protein, 9 aa, Artificial Sequence
  Description of Artificial Sequence: Synthetic peptide
  Seed: LLMWITQCF (CTG1B_HUMAN)
LAMWITQCM

SEQ ID NO: 29671 - protein, 9 aa, Artificial Sequence
  Description of Artificial Sequence: Synthetic peptide
  Seed: FATPMEAEL (CTG1B_HUMAN)
FPTPMEAEM

SEQ ID NO: 29672 - protein, 10 aa, Artificial Sequence
  Description of Artificial Sequence: Synthetic peptide
  Seed: LQQLSLLMWI (CTG1B_HUMAN)
LPQLSLLMWV

SEQ ID NO: 29673 - protein, 11 aa, Artificial Sequence
  Description of Artificial Sequence: Synthetic peptide
  Seed: FYLAMPFATPM (CTG1B_HUMAN)
FPLAMPFATPL

SEQ ID NO: 29674 - protein, 9 aa, Artificial Sequence
  Description of Artificial Sequence: Synthetic peptide
  Seed: LAMPFATPM (CTG1B_HUMAN)
LMMPFATPV

SEQ ID NO: 29675 - protein, 9 aa, Artificial Sequence
  Description of Artificial Sequence: Synthetic peptide
  Seed: MQAEGRGTG (CTG1B_HUMAN)
MSAEGRGTY

SEQ ID NO: 29676 - protein, 9 aa, Artificial Sequence
  Description of Artificial Sequence: Synthetic peptide
  Seed: SLLMWITQC (CTG1B_HUMAN)
STLMWITQI

SEQ ID NO: 29677 - protein, 10 aa, Artificial Sequence
  Description of Artificial Sequence: Synthetic peptide
  Seed: YLAMPFATPM (CTG1B_HUMAN)
YEAMPFATPW

SEQ ID NO: 29678 - protein, 9 aa, Artificial Sequence
  Description of Artificial Sequence: Synthetic peptide
  Seed: TVSGNILTI (CTG1B_HUMAN)
TLSGNILTY

SEQ ID NO: 29679 - protein, 9 aa, Artificial Sequence
  Description of Artificial Sequence: Synthetic peptide
  Seed: TVSGNILTI (CTG1B_HUMAN)
TTSGNILTV

SEQ ID NO: 29680 - protein, 9 aa, Artificial Sequence
  Description of Artificial Sequence: Synthetic peptide
  Seed: LEFYLAMPF (CTG1B_HUMAN)
LEFYLAMPT

SEQ ID NO: 29681 - protein, 9 aa, Artificial Sequence
  Description of Artificial Sequence: Synthetic peptide
  Seed: ILTIRLTAA (CTG1B_HUMAN)
IATIRLTAL

SEQ ID NO: 29682 - protein, 11 aa, Artificial Sequence
  Description of Artificial Sequence: Synthetic peptide
  Seed: RLLEFYLAMPF (CTG1B_HUMAN)
RSLEFYLAMPI

SEQ ID NO: 29683 - protein, 9 aa, Artificial Sequence
  Description of Artificial Sequence: Synthetic peptide
  Seed: SRLLEFYLA (CTG1B_HUMAN)
SRLLEFYLV

SEQ ID NO: 29684 - protein, 10 aa, Artificial Sequence
  Description of Artificial Sequence: Synthetic peptide
  Seed: FYLAMPFATP (CTG1B_HUMAN)
FDLAMPFATI

SEQ ID NO: 29685 - protein, 9 aa, Artificial Sequence
  Description of Artificial Sequence: Synthetic peptide
  Seed: ARGPESRLL (CTG1B_HUMAN)
ARGPESRLM

SEQ ID NO: 29686 - protein, 9 aa, Artificial Sequence
  Description of Artificial Sequence: Synthetic peptide
  Seed: RLLEFYLAM (CTG1B_HUMAN)
RGLEFYLAY

SEQ ID NO: 29687 - protein, 9 aa, Artificial Sequence
  Description of Artificial Sequence: Synthetic peptide
  Seed: RQLQLSISS (CTG1B_HUMAN)
RNLQLSISF

SEQ ID NO: 29688 - protein, 10 aa, Artificial Sequence
  Description of Artificial Sequence: Synthetic peptide
  Seed: EFTVSGNILT (CTG1B_HUMAN)
EFTVSGNILI

SEQ ID NO: 29689 - protein, 11 aa, Artificial Sequence
  Description of Artificial Sequence: Synthetic peptide
  Seed: RQLQLSISSCL (CTG1B_HUMAN)
RTLQLSISSCF

SEQ ID NO: 29690 - protein, 10 aa, Artificial Sequence
  Description of Artificial Sequence: Synthetic peptide
  Seed: TVSGNILTIR (CTG1B_HUMAN)
TMSGNILTIR

SEQ ID NO: 29691 - protein, 9 aa, Artificial Sequence
  Description of Artificial Sequence: Synthetic peptide
  Seed: LAMPFATPM (CTG1B_HUMAN)
LAMPFATPH

SEQ ID NO: 29692 - protein, 10 aa, Artificial Sequence
  Description of Artificial Sequence: Synthetic peptide
  Seed: MWITQCFLPV (CTG1B_HUMAN)
MVITQCFLPA

SEQ ID NO: 29693 - protein, 10 aa, Artificial Sequence
  Description of Artificial Sequence: Synthetic peptide
  Seed: LEFYLAMPFA (CTG1B_HUMAN)
LQFYLAMPFL

SEQ ID NO: 29694 - protein, 9 aa, Artificial Sequence
  Description of Artificial Sequence: Synthetic peptide
  Seed: LAMPFATPM (CTG1B_HUMAN)
LKMPFATPV

SEQ ID NO: 29695 - protein, 9 aa, Artificial Sequence
  Description of Artificial Sequence: Synthetic peptide
  Seed: FATPMEAEL (CTG1B_HUMAN)
FQTPMEAEY

SEQ ID NO: 29696 - protein, 9 aa, Artificial Sequence
  Description of Artificial Sequence: Synthetic peptide
  Seed: SLAQDAPPL (CTG1B_HUMAN)
SKAQDAPPY

SEQ ID NO: 29697 - protein, 10 aa, Artificial Sequence
  Description of Artificial Sequence: Synthetic peptide
  Seed: GIPDGPGGNA (CTG1B_HUMAN)
GSPDGPGGNL

SEQ ID NO: 29698 - protein, 9 aa, Artificial Sequence
  Description of Artificial Sequence: Synthetic peptide
  Seed: TPMEAELAR (CTG1B_HUMAN)
TSMEAELAR

SEQ ID NO: 29699 - protein, 10 aa, Artificial Sequence
  Description of Artificial Sequence: Synthetic peptide
  Seed: FLPVFLAQPP (CTG1B_HUMAN)
FQPVFLAQPT

SEQ ID NO: 29700 - protein, 11 aa, Artificial Sequence
  Description of Artificial Sequence: Synthetic peptide
  Seed: FYLAMPFATPM (CTG1B_HUMAN)
FELAMPFATPY

SEQ ID NO: 29701 - protein, 10 aa, Artificial Sequence
  Description of Artificial Sequence: Synthetic peptide
  Seed: SRLLEFYLAM (CTG1B_HUMAN)
SKLLEFYLAV

SEQ ID NO: 29702 - protein, 10 aa, Artificial Sequence
  Description of Artificial Sequence: Synthetic peptide
  Seed: RGPHGGAASG (CTG1B_HUMAN)
RGPHGGAASF

SEQ ID NO: 29703 - protein, 9 aa, Artificial Sequence
  Description of Artificial Sequence: Synthetic peptide
  Seed: ITQCFLPVF (CTG1B_HUMAN)
ITQCFLPVM

SEQ ID NO: 29704 - protein, 10 aa, Artificial Sequence
  Description of Artificial Sequence: Synthetic peptide
  Seed: GPRGAGAARA (CTG1B_HUMAN)
GPRGAGAARM

SEQ ID NO: 29705 - protein, 9 aa, Artificial Sequence
  Description of Artificial Sequence: Synthetic peptide
  Seed: AQDAPPLPV (CTG1B_HUMAN)
AYDAPPLPL

SEQ ID NO: 29706 - protein, 8 aa, Artificial Sequence
  Description of Artificial Sequence: Synthetic peptide
  Seed: HRQLQLSI (CTG1B_HUMAN)
HHQLQLSL

SEQ ID NO: 29707 - protein, 9 aa, Artificial Sequence
  Description of Artificial Sequence: Synthetic peptide
  Seed: RLLEFYLAM (CTG1B_HUMAN)
RTLEFYLAR

SEQ ID NO: 29708 - protein, 11 aa, Artificial Sequence
  Description of Artificial Sequence: Synthetic peptide
  Seed: RQLQLSISSCL (CTG1B_HUMAN)
RWLQLSISSCY

SEQ ID NO: 29709 - protein, 10 aa, Artificial Sequence
  Description of Artificial Sequence: Synthetic peptide
  Seed: LLMWITQCFL (CTG1B_HUMAN)
LVMWITQCFV

SEQ ID NO: 29710 - protein, 9 aa, Artificial Sequence
  Description of Artificial Sequence: Synthetic peptide
  Seed: TVSGNILTI (CTG1B_HUMAN)
TTSGNILTM

SEQ ID NO: 29711 - protein, 11 aa, Artificial Sequence
  Description of Artificial Sequence: Synthetic peptide
  Seed: GRGPRGAGAAR (CTG1B_HUMAN)
GRGPRGAGAAL

SEQ ID NO: 29712 - protein, 9 aa, Artificial Sequence
  Description of Artificial Sequence: Synthetic peptide
  Seed: RLLEFYLAM (CTG1B_HUMAN)
RALEFYLAI

SEQ ID NO: 29713 - protein, 10 aa, Artificial Sequence
  Description of Artificial Sequence: Synthetic peptide
  Seed: RLLEFYLAMP (CTG1B_HUMAN)
RDLEFYLAMV

SEQ ID NO: 29714 - protein, 9 aa, Artificial Sequence
  Description of Artificial Sequence: Synthetic peptide
  Seed: RLLEFYLAM (CTG1B_HUMAN)
RMLEFYLAF

SEQ ID NO: 29715 - protein, 9 aa, Artificial Sequence
  Description of Artificial Sequence: Synthetic peptide
  Seed: LQQLSLLMW (CTG1B_HUMAN)
LHQLSLLMY

SEQ ID NO: 29716 - protein, 9 aa, Artificial Sequence
  Description of Artificial Sequence: Synthetic peptide
  Seed: GVLLKEFTV (CTG1B_HUMAN)
GQLLKEFTL

SEQ ID NO: 29717 - protein, 10 aa, Artificial Sequence
  Description of Artificial Sequence: Synthetic peptide
  Seed: FYLAMPFATP (CTG1B_HUMAN)
FTLAMPFATV

SEQ ID NO: 29718 - protein, 11 aa, Artificial Sequence
  Description of Artificial Sequence: Synthetic peptide
  Seed: APRGPHGGAAS (CTG1B_HUMAN)
APRGPHGGAAT

SEQ ID NO: 29719 - protein, 10 aa, Artificial Sequence
  Description of Artificial Sequence: Synthetic peptide
  Seed: MEAELARRSL (CTG1B_HUMAN)
MEAELARRSA

SEQ ID NO: 29720 - protein, 9 aa, Artificial Sequence
  Description of Artificial Sequence: Synthetic peptide
  Seed: LAQPPSGQR (CTG1B_HUMAN)
LYQPPSGQR

SEQ ID NO: 29721 - protein, 9 aa, Artificial Sequence
  Description of Artificial Sequence: Synthetic peptide
  Seed: TVSGNILTI (CTG1B_HUMAN)
TISGNILTV

SEQ ID NO: 29722 - protein, 9 aa, Artificial Sequence
  Description of Artificial Sequence: Synthetic peptide
  Seed: VSGNILTIR (CTG1B_HUMAN)
VMGNILTIK

SEQ ID NO: 29723 - protein, 9 aa, Artificial Sequence
  Description of Artificial Sequence: Synthetic peptide
  Seed: LAMPFATPM (CTG1B_HUMAN)
LKMPFATPL

SEQ ID NO: 29724 - protein, 9 aa, Artificial Sequence
  Description of Artificial Sequence: Synthetic peptide
  Seed: MPFATPMEA (CTG1B_HUMAN)
MIFATPMEI

SEQ ID NO: 29725 - protein, 11 aa, Artificial Sequence
  Description of Artificial Sequence: Synthetic peptide
  Seed: RLLEFYLAMPF (CTG1B_HUMAN)
RDLEFYLAMPL

SEQ ID NO: 29726 - protein, 9 aa, Artificial Sequence
  Description of Artificial Sequence: Synthetic peptide
  Seed: RLLEFYLAM (CTG1B_HUMAN)
RQLEFYLAA

SEQ ID NO: 29727 - protein, 9 aa, Artificial Sequence
  Description of Artificial Sequence: Synthetic peptide
  Seed: SLLMWITQC (CTG1B_HUMAN)
SMLMWITQT

SEQ ID NO: 29728 - protein, 10 aa, Artificial Sequence
  Description of Artificial Sequence: Synthetic peptide
  Seed: YLAMPFATPM (CTG1B_HUMAN)
YIAMPFATPF

SEQ ID NO: 29729 - protein, 9 aa, Artificial Sequence
  Description of Artificial Sequence: Synthetic peptide
  Seed: FTVSGNILT (CTG1B_HUMAN)
FMVSGNILI

SEQ ID NO: 29730 - protein, 11 aa, Artificial Sequence
  Description of Artificial Sequence: Synthetic peptide
  Seed: RQLQLSISSCL (CTG1B_HUMAN)
RTLQLSISSCY

SEQ ID NO: 29731 - protein, 10 aa, Artificial Sequence
  Description of Artificial Sequence: Synthetic peptide
  Seed: RGPESRLLEF (CTG1B_HUMAN)
RMPESRLLEL

SEQ ID NO: 29732 - protein, 10 aa, Artificial Sequence
  Description of Artificial Sequence: Synthetic peptide
  Seed: YLAMPFATPM (CTG1B_HUMAN)
YEAMPFATPY

SEQ ID NO: 29733 - protein, 10 aa, Artificial Sequence
  Description of Artificial Sequence: Synthetic peptide
  Seed: KEFTVSGNIL (CTG1B_HUMAN)
KEFTVSGNIW

SEQ ID NO: 29734 - protein, 9 aa, Artificial Sequence
  Description of Artificial Sequence: Synthetic peptide
  Seed: LAQPPSGQR (CTG1B_HUMAN)
LVQPPSGQR

SEQ ID NO: 29735 - protein, 10 aa, Artificial Sequence
  Description of Artificial Sequence: Synthetic peptide
  Seed: SLLMWITQCF (CTG1B_HUMAN)
SELMWITQCY

SEQ ID NO: 29736 - protein, 9 aa, Artificial Sequence
  Description of Artificial Sequence: Synthetic peptide
  Seed: VSGNILTIR (CTG1B_HUMAN)
VAGNILTIM

SEQ ID NO: 29737 - protein, 10 aa, Artificial Sequence
  Description of Artificial Sequence: Synthetic peptide
  Seed: TPMEAELARR (CTG1B_HUMAN)
TMMEAELARR

SEQ ID NO: 29738 - protein, 9 aa, Artificial Sequence
  Description of Artificial Sequence: Synthetic peptide
  Seed: RLLEFYLAM (CTG1B_HUMAN)
RHLEFYLAY

SEQ ID NO: 29739 - protein, 10 aa, Artificial Sequence
  Description of Artificial Sequence: Synthetic peptide
  Seed: YLAMPFATPM (CTG1B_HUMAN)
YNAMPFATPY

SEQ ID NO: 29740 - protein, 9 aa, Artificial Sequence
  Description of Artificial Sequence: Synthetic peptide
  Seed: FTVSGNILT (CTG1B_HUMAN)
FLVSGNILT

SEQ ID NO: 29741 - protein, 10 aa, Artificial Sequence
  Description of Artificial Sequence: Synthetic peptide
  Seed: FYLAMPFATP (CTG1B_HUMAN)
FELAMPFATA

SEQ ID NO: 29742 - protein, 9 aa, Artificial Sequence
  Description of Artificial Sequence: Synthetic peptide
  Seed: LQLSISSCL (CTG1B_HUMAN)
LQLSISSCY

SEQ ID NO: 29743 - protein, 11 aa, Artificial Sequence
  Description of Artificial Sequence: Synthetic peptide
  Seed: FYLAMPFATPM (CTG1B_HUMAN)
FMLAMPFATPT

SEQ ID NO: 29744 - protein, 11 aa, Artificial Sequence
  Description of Artificial Sequence: Synthetic peptide
  Seed: FYLAMPFATPM (CTG1B_HUMAN)
FYLAMPFATPY

SEQ ID NO: 29745 - protein, 10 aa, Artificial Sequence
  Description of Artificial Sequence: Synthetic peptide
  Seed: RGPHGGAASG (CTG1B_HUMAN)
RPPHGGAASA

SEQ ID NO: 29746 - protein, 9 aa, Artificial Sequence
  Description of Artificial Sequence: Synthetic peptide
  Seed: AADHRQLQL (CTG1B_HUMAN)
ALDHRQLQM

SEQ ID NO: 29747 - protein, 10 aa, Artificial Sequence
  Description of Artificial Sequence: Synthetic peptide
  Seed: FYLAMPFATP (CTG1B_HUMAN)
FNLAMPFATT

SEQ ID NO: 29748 - protein, 9 aa, Artificial Sequence
  Description of Artificial Sequence: Synthetic peptide
  Seed: TAADHRQLQ (CTG1B_HUMAN)
TAADHRQLM

SEQ ID NO: 29749 - protein, 10 aa, Artificial Sequence
  Description of Artificial Sequence: Synthetic peptide
  Seed: MPFATPMEAE (CTG1B_HUMAN)
MMFATPMEAY

SEQ ID NO: 29750 - protein, 9 aa, Artificial Sequence
  Description of Artificial Sequence: Synthetic peptide
  Seed: LAMPFATPM (CTG1B_HUMAN)
LTMPFATPM

SEQ ID NO: 29751 - protein, 10 aa, Artificial Sequence
  Description of Artificial Sequence: Synthetic peptide
  Seed: RGPHGGAASG (CTG1B_HUMAN)
RLPHGGAASV

SEQ ID NO: 29752 - protein, 10 aa, Artificial Sequence
  Description of Artificial Sequence: Synthetic peptide
  Seed: SRLLEFYLAM (CTG1B_HUMAN)
SWLLEFYLAV

SEQ ID NO: 29753 - protein, 9 aa, Artificial Sequence
  Description of Artificial Sequence: Synthetic peptide
  Seed: FATPMEAEL (CTG1B_HUMAN)
FRTPMEAEV

SEQ ID NO: 29754 - protein, 10 aa, Artificial Sequence
  Description of Artificial Sequence: Synthetic peptide
  Seed: RLTAADHRQL (CTG1B_HUMAN)
RYTAADHRQF

SEQ ID NO: 29755 - protein, 8 aa, Artificial Sequence
  Description of Artificial Sequence: Synthetic peptide
  Seed: GPRGAGAA (CTG1B_HUMAN)
GPRGAGAM

SEQ ID NO: 29756 - protein, 11 aa, Artificial Sequence
  Description of Artificial Sequence: Synthetic peptide
  Seed: LAMPFATPMEA (CTG1B_HUMAN)
LMMPFATPMEA

SEQ ID NO: 29757 - protein, 10 aa, Artificial Sequence
  Description of Artificial Sequence: Synthetic peptide
  Seed: EFTVSGNILT (CTG1B_HUMAN)
EKTVSGNILI

SEQ ID NO: 29758 - protein, 9 aa, Artificial Sequence
  Description of Artificial Sequence: Synthetic peptide
  Seed: ASGPGGGAP (CTG1B_HUMAN)
AAGPGGGAM

SEQ ID NO: 29759 - protein, 10 aa, Artificial Sequence
  Description of Artificial Sequence: Synthetic peptide
  Seed: YLAMPFATPM (CTG1B_HUMAN)
YSAMPFATPF

SEQ ID NO: 29760 - protein, 10 aa, Artificial Sequence
  Description of Artificial Sequence: Synthetic peptide
  Seed: FTVSGNILTI (CTG1B_HUMAN)
FPVSGNILTI

SEQ ID NO: 29761 - protein, 9 aa, Artificial Sequence
  Description of Artificial Sequence: Synthetic peptide
  Seed: RQLQLSISS (CTG1B_HUMAN)
RLLQLSISI

SEQ ID NO: 29762 - protein, 9 aa, Artificial Sequence
  Description of Artificial Sequence: Synthetic peptide
  Seed: FTVSGNILT (CTG1B_HUMAN)
FMVSGNILL

SEQ ID NO: 29763 - protein, 11 aa, Artificial Sequence
  Description of Artificial Sequence: Synthetic peptide
  Seed: ARASGPGGGAP (CTG1B_HUMAN)
ARASGPGGGAF

SEQ ID NO: 29764 - protein, 11 aa, Artificial Sequence
  Description of Artificial Sequence: Synthetic peptide
  Seed: RLLEFYLAMPF (CTG1B_HUMAN)
RHLEFYLAMPL

SEQ ID NO: 29765 - protein, 9 aa, Artificial Sequence
  Description of Artificial Sequence: Synthetic peptide
  Seed: AADHRQLQL (CTG1B_HUMAN)
AADHRQLQV

SEQ ID NO: 29766 - protein, 11 aa, Artificial Sequence
  Description of Artificial Sequence: Synthetic peptide
  Seed: LAMPFATPMEA (CTG1B_HUMAN)
LNMPFATPMEA

SEQ ID NO: 29767 - protein, 10 aa, Artificial Sequence
  Description of Artificial Sequence: Synthetic peptide
  Seed: RGPHGGAASG (CTG1B_HUMAN)
RAPHGGAASL

SEQ ID NO: 29768 - protein, 10 aa, Artificial Sequence
  Description of Artificial Sequence: Synthetic peptide
  Seed: SRLLEFYLAM (CTG1B_HUMAN)
SMLLEFYLAI

SEQ ID NO: 29769 - protein, 9 aa, Artificial Sequence
  Description of Artificial Sequence: Synthetic peptide
  Seed: LAQPPSGQR (CTG1B_HUMAN)
LSQPPSGQY

SEQ ID NO: 29770 - protein, 11 aa, Artificial Sequence
  Description of Artificial Sequence: Synthetic peptide
  Seed: GDADGPGGPGI (CTG1B_HUMAN)
GEADGPGGPGM

SEQ ID NO: 29771 - protein, 11 aa, Artificial Sequence
  Description of Artificial Sequence: Synthetic peptide
  Seed: RLLEFYLAMPF (CTG1B_HUMAN)
RKLEFYLAMPY

SEQ ID NO: 29772 - protein, 9 aa, Artificial Sequence
  Description of Artificial Sequence: Synthetic peptide
  Seed: AARASGPGG (CTG1B_HUMAN)
ASRASGPGK

SEQ ID NO: 29773 - protein, 9 aa, Artificial Sequence
  Description of Artificial Sequence: Synthetic peptide
  Seed: RLLEFYLAM (CTG1B_HUMAN)
RFLEFYLAK

SEQ ID NO: 29774 - protein, 9 aa, Artificial Sequence
  Description of Artificial Sequence: Synthetic peptide
  Seed: LAQPPSGQR (CTG1B_HUMAN)
LGQPPSGQY

SEQ ID NO: 29775 - protein, 11 aa, Artificial Sequence
  Description of Artificial Sequence: Synthetic peptide
  Seed: FYLAMPFATPM (CTG1B_HUMAN)
FQLAMPFATPF

SEQ ID NO: 29776 - protein, 9 aa, Artificial Sequence
  Description of Artificial Sequence: Synthetic peptide
  Seed: LAMPFATPM (CTG1B_HUMAN)
LVMPFATPL

SEQ ID NO: 29777 - protein, 9 aa, Artificial Sequence
  Description of Artificial Sequence: Synthetic peptide
  Seed: LLMWITQCF (CTG1B_HUMAN)
LPMWITQCH

SEQ ID NO: 29778 - protein, 9 aa, Artificial Sequence
  Description of Artificial Sequence: Synthetic peptide
  Seed: AARASGPGG (CTG1B_HUMAN)
ASRASGPGM

SEQ ID NO: 29779 - protein, 10 aa, Artificial Sequence
  Description of Artificial Sequence: Synthetic peptide
  Seed: SRLLEFYLAM (CTG1B_HUMAN)
SKLLEFYLAM

SEQ ID NO: 29780 - protein, 11 aa, Artificial Sequence
  Description of Artificial Sequence: Synthetic peptide
  Seed: GAPRGPHGGAA (CTG1B_HUMAN)
GSPRGPHGGAL

SEQ ID NO: 29781 - protein, 9 aa, Artificial Sequence
  Description of Artificial Sequence: Synthetic peptide
  Seed: AARASGPGG (CTG1B_HUMAN)
AVRASGPGV

SEQ ID NO: 29782 - protein, 9 aa, Artificial Sequence
  Description of Artificial Sequence: Synthetic peptide
  Seed: LPVFLAQPP (CTG1B_HUMAN)
LAVFLAQPM

SEQ ID NO: 29783 - protein, 9 aa, Artificial Sequence
  Description of Artificial Sequence: Synthetic peptide
  Seed: LAMPFATPM (CTG1B_HUMAN)
LPMPFATPT

SEQ ID NO: 29784 - protein, 11 aa, Artificial Sequence
  Description of Artificial Sequence: Synthetic peptide
  Seed: MPFATPMEAEL (CTG1B_HUMAN)
MPFATPMEAEW

SEQ ID NO: 29785 - protein, 10 aa, Artificial Sequence
  Description of Artificial Sequence: Synthetic peptide
  Seed: YLAMPFATPM (CTG1B_HUMAN)
YMAMPFATPI

SEQ ID NO: 29786 - protein, 10 aa, Artificial Sequence
  Description of Artificial Sequence: Synthetic peptide
  Seed: GAPRGPHGGA (CTG1B_HUMAN)
GCPRGPHGGL

SEQ ID NO: 29787 - protein, 9 aa, Artificial Sequence
  Description of Artificial Sequence: Synthetic peptide
  Seed: LEFYLAMPF (CTG1B_HUMAN)
LEFYLAMPM

SEQ ID NO: 29788 - protein, 10 aa, Artificial Sequence
  Description of Artificial Sequence: Synthetic peptide
  Seed: LLMWITQCFL (CTG1B_HUMAN)
LIMWITQCFK

SEQ ID NO: 29789 - protein, 9 aa, Artificial Sequence
  Description of Artificial Sequence: Synthetic peptide
  Seed: APRGPHGGA (CTG1B_HUMAN)
AARGPHGGL

SEQ ID NO: 29790 - protein, 10 aa, Artificial Sequence
  Description of Artificial Sequence: Synthetic peptide
  Seed: SRLLEFYLAM (CTG1B_HUMAN)
SILLEFYLAA

SEQ ID NO: 29791 - protein, 10 aa, Artificial Sequence
  Description of Artificial Sequence: Synthetic peptide
  Seed: RLLEFYLAMP (CTG1B_HUMAN)
RVLEFYLAMI

SEQ ID NO: 29792 - protein, 9 aa, Artificial Sequence
  Description of Artificial Sequence: Synthetic peptide
  Seed: TPMEAELAR (CTG1B_HUMAN)
TIMEAELAR

SEQ ID NO: 29793 - protein, 9 aa, Artificial Sequence
  Description of Artificial Sequence: Synthetic peptide
  Seed: VSGNILTIR (CTG1B_HUMAN)
VVGNILTIK

SEQ ID NO: 29794 - protein, 10 aa, Artificial Sequence
  Description of Artificial Sequence: Synthetic peptide
  Seed: ISSCLQQLSL (CTG1B_HUMAN)
IMSCLQQLSW

SEQ ID NO: 29795 - protein, 10 aa, Artificial Sequence
  Description of Artificial Sequence: Synthetic peptide
  Seed: RLLEFYLAMP (CTG1B_HUMAN)
RSLEFYLAMV

SEQ ID NO: 29796 - protein, 9 aa, Artificial Sequence
  Description of Artificial Sequence: Synthetic peptide
  Seed: FATPMEAEL (CTG1B_HUMAN)
FTTPMEAEI

SEQ ID NO: 29797 - protein, 9 aa, Artificial Sequence
  Description of Artificial Sequence: Synthetic peptide
  Seed: LTAADHRQL (CTG1B_HUMAN)
LTAADHRQY

SEQ ID NO: 29798 - protein, 11 aa, Artificial Sequence
  Description of Artificial Sequence: Synthetic peptide
  Seed: RASGPGGGAPR (CTG1B_HUMAN)
RQSGPGGGAPM

SEQ ID NO: 29799 - protein, 10 aa, Artificial Sequence
  Description of Artificial Sequence: Synthetic peptide
  Seed: LAQPPSGQRR (CTG1B_HUMAN)
LVQPPSGQRK

SEQ ID NO: 29800 - protein, 9 aa, Artificial Sequence
  Description of Artificial Sequence: Synthetic peptide
  Seed: SGPGGGAPR (CTG1B_HUMAN)
SLPGGGAPF

SEQ ID NO: 29801 - protein, 9 aa, Artificial Sequence
  Description of Artificial Sequence: Synthetic peptide
  Seed: SSCLQQLSL (CTG1B_HUMAN)
SRCLQQLSY

SEQ ID NO: 29802 - protein, 9 aa, Artificial Sequence
  Description of Artificial Sequence: Synthetic peptide
  Seed: SISSCLQQL (CTG1B_HUMAN)
SQSSCLQQI

SEQ ID NO: 29803 - protein, 9 aa, Artificial Sequence
  Description of Artificial Sequence: Synthetic peptide
  Seed: SSCLQQLSL (CTG1B_HUMAN)
SVCLQQLSY

SEQ ID NO: 29804 - protein, 9 aa, Artificial Sequence
  Description of Artificial Sequence: Synthetic peptide
  Seed: LAMPFATPM (CTG1B_HUMAN)
LEMPFATPY

SEQ ID NO: 29805 - protein, 11 aa, Artificial Sequence
  Description of Artificial Sequence: Synthetic peptide
  Seed: FYLAMPFATPM (CTG1B_HUMAN)
FQLAMPFATPI

SEQ ID NO: 29806 - protein, 9 aa, Artificial Sequence
  Description of Artificial Sequence: Synthetic peptide
  Seed: TPMEAELAR (CTG1B_HUMAN)
TSMEAELAF

SEQ ID NO: 29807 - protein, 10 aa, Artificial Sequence
  Description of Artificial Sequence: Synthetic peptide
  Seed: TAADHRQLQL (CTG1B_HUMAN)
TTADHRQLQF

SEQ ID NO: 29808 - protein, 10 aa, Artificial Sequence
  Description of Artificial Sequence: Synthetic peptide
  Seed: MEAELARRSL (CTG1B_HUMAN)
MEAELARRSI

SEQ ID NO: 29809 - protein, 9 aa, Artificial Sequence
  Description of Artificial Sequence: Synthetic peptide
  Seed: LLMWITQCF (CTG1B_HUMAN)
LVMWITQCY

SEQ ID NO: 29810 - protein, 10 aa, Artificial Sequence
  Description of Artificial Sequence: Synthetic peptide
  Seed: LEFYLAMPFA (CTG1B_HUMAN)
LKFYLAMPFY

SEQ ID NO: 29811 - protein, 10 aa, Artificial Sequence
  Description of Artificial Sequence: Synthetic peptide
  Seed: AASGLNGCCR (CTG1B_HUMAN)
AVSGLNGCCR

SEQ ID NO: 29812 - protein, 9 aa, Artificial Sequence
  Description of Artificial Sequence: Synthetic peptide
  Seed: IPDGPGGNA (CTG1B_HUMAN)
IADGPGGNF

SEQ ID NO: 29813 - protein, 11 aa, Artificial Sequence
  Description of Artificial Sequence: Synthetic peptide
  Seed: RASGPGGGAPR (CTG1B_HUMAN)
RLSGPGGGAPF

SEQ ID NO: 29814 - protein, 9 aa, Artificial Sequence
  Description of Artificial Sequence: Synthetic peptide
  Seed: RLLEFYLAM (CTG1B_HUMAN)
RILEFYLAY

SEQ ID NO: 29815 - protein, 9 aa, Artificial Sequence
  Description of Artificial Sequence: Synthetic peptide
  Seed: LAMPFATPM (CTG1B_HUMAN)
LPMPFATPL

SEQ ID NO: 29816 - protein, 11 aa, Artificial Sequence
  Description of Artificial Sequence: Synthetic peptide
  Seed: GAPRGPHGGAA (CTG1B_HUMAN)
GMPRGPHGGAL

SEQ ID NO: 29817 - protein, 9 aa, Artificial Sequence
  Description of Artificial Sequence: Synthetic peptide
  Seed: MPFATPMEA (CTG1B_HUMAN)
MAFATPMEV

SEQ ID NO: 29818 - protein, 10 aa, Artificial Sequence
  Description of Artificial Sequence: Synthetic peptide
  Seed: TPMEAELARR (CTG1B_HUMAN)
TVMEAELARK

SEQ ID NO: 29819 - protein, 9 aa, Artificial Sequence
  Description of Artificial Sequence: Synthetic peptide
  Seed: WITQCFLPV (CTG1B_HUMAN)
WVTQCFLPV

SEQ ID NO: 29820 - protein, 11 aa, Artificial Sequence
  Description of Artificial Sequence: Synthetic peptide
  Seed: FYLAMPFATPM (CTG1B_HUMAN)
FLLAMPFATPT

SEQ ID NO: 29821 - protein, 9 aa, Artificial Sequence
  Description of Artificial Sequence: Synthetic peptide
  Seed: FTVSGNILT (CTG1B_HUMAN)
FQVSGNILL

SEQ ID NO: 29822 - protein, 10 aa, Artificial Sequence
  Description of Artificial Sequence: Synthetic peptide
  Seed: LMWITQCFLP (CTG1B_HUMAN)
LLWITQCFLI

SEQ ID NO: 29823 - protein, 9 aa, Artificial Sequence
  Description of Artificial Sequence: Synthetic peptide
  Seed: SLLMWITQC (CTG1B_HUMAN)
SVLMWITQA

SEQ ID NO: 29824 - protein, 10 aa, Artificial Sequence
  Description of Artificial Sequence: Synthetic peptide
  Seed: MWITQCFLPV (CTG1B_HUMAN)
MWITQCFLPW

SEQ ID NO: 29825 - protein, 9 aa, Artificial Sequence
  Description of Artificial Sequence: Synthetic peptide
  Seed: AADHRQLQL (CTG1B_HUMAN)
AVDHRQLQV

SEQ ID NO: 29826 - protein, 11 aa, Artificial Sequence
  Description of Artificial Sequence: Synthetic peptide
  Seed: FYLAMPFATPM (CTG1B_HUMAN)
FILAMPFATPY

SEQ ID NO: 29827 - protein, 9 aa, Artificial Sequence
  Description of Artificial Sequence: Synthetic peptide
  Seed: APPLPVPGV (CTG1B_HUMAN)
AQPLPVPGL

SEQ ID NO: 29828 - protein, 9 aa, Artificial Sequence
  Description of Artificial Sequence: Synthetic peptide
  Seed: RLLEFYLAM (CTG1B_HUMAN)
RNLEFYLAK

SEQ ID NO: 29829 - protein, 9 aa, Artificial Sequence
  Description of Artificial Sequence: Synthetic peptide
  Seed: SGPGGGAPR (CTG1B_HUMAN)
SVPGGGAPM

SEQ ID NO: 29830 - protein, 9 aa, Artificial Sequence
  Description of Artificial Sequence: Synthetic peptide
  Seed: TVSGNILTI (CTG1B_HUMAN)
TYSGNILTY

SEQ ID NO: 29831 - protein, 9 aa, Artificial Sequence
  Description of Artificial Sequence: Synthetic peptide
  Seed: SLAQDAPPL (CTG1B_HUMAN)
SLAQDAPPF

SEQ ID NO: 29832 - protein, 9 aa, Artificial Sequence
  Description of Artificial Sequence: Synthetic peptide
  Seed: LAMPFATPM (CTG1B_HUMAN)
LMMPFATPM

SEQ ID NO: 29833 - protein, 10 aa, Artificial Sequence
  Description of Artificial Sequence: Synthetic peptide
  Seed: MPFATPMEAE (CTG1B_HUMAN)
MGFATPMEAY

SEQ ID NO: 29834 - protein, 9 aa, Artificial Sequence
  Description of Artificial Sequence: Synthetic peptide
  Seed: LPVPGVLLK (CTG1B_HUMAN)
LPVPGVLLP

SEQ ID NO: 29835 - protein, 9 aa, Artificial Sequence
  Description of Artificial Sequence: Synthetic peptide
  Seed: LEFYLAMPF (CTG1B_HUMAN)
LMFYLAMPM

SEQ ID NO: 29836 - protein, 11 aa, Artificial Sequence
  Description of Artificial Sequence: Synthetic peptide
  Seed: YLAMPFATPME (CTG1B_HUMAN)
YMAMPFATPML

SEQ ID NO: 29837 - protein, 9 aa, Artificial Sequence
  Description of Artificial Sequence: Synthetic peptide
  Seed: SLAQDAPPL (CTG1B_HUMAN)
SLAQDAPPM

SEQ ID NO: 29838 - protein, 9 aa, Artificial Sequence
  Description of Artificial Sequence: Synthetic peptide
  Seed: YLAMPFATP (CTG1B_HUMAN)
YLAMPFATT

SEQ ID NO: 29839 - protein, 10 aa, Artificial Sequence
  Description of Artificial Sequence: Synthetic peptide
  Seed: YLAMPFATPM (CTG1B_HUMAN)
YPAMPFATPF

SEQ ID NO: 29840 - protein, 10 aa, Artificial Sequence
  Description of Artificial Sequence: Synthetic peptide
  Seed: SRLLEFYLAM (CTG1B_HUMAN)
SPLLEFYLAL

SEQ ID NO: 29841 - protein, 10 aa, Artificial Sequence
  Description of Artificial Sequence: Synthetic peptide
  Seed: YLAMPFATPM (CTG1B_HUMAN)
YCAMPFATPA

SEQ ID NO: 29842 - protein, 10 aa, Artificial Sequence
  Description of Artificial Sequence: Synthetic peptide
  Seed: GIPDGPGGNA (CTG1B_HUMAN)
GLPDGPGGNF

SEQ ID NO: 29843 - protein, 8 aa, Artificial Sequence
  Description of Artificial Sequence: Synthetic peptide
  Seed: RGPESRLL (CTG1B_HUMAN)
RAPESRLL

SEQ ID NO: 29844 - protein, 10 aa, Artificial Sequence
  Description of Artificial Sequence: Synthetic peptide
  Seed: TAADHRQLQL (CTG1B_HUMAN)
TYADHRQLQF

SEQ ID NO: 29845 - protein, 10 aa, Artificial Sequence
  Description of Artificial Sequence: Synthetic peptide
  Seed: FYLAMPFATP (CTG1B_HUMAN)
FSLAMPFATA

SEQ ID NO: 29846 - protein, 9 aa, Artificial Sequence
  Description of Artificial Sequence: Synthetic peptide
  Seed: TQCFLPVFL (CTG1B_HUMAN)
TMCFLPVFL

SEQ ID NO: 29847 - protein, 9 aa, Artificial Sequence
  Description of Artificial Sequence: Synthetic peptide
  Seed: LLMWITQCF (CTG1B_HUMAN)
LLMWITQCY

SEQ ID NO: 29848 - protein, 10 aa, Artificial Sequence
  Description of Artificial Sequence: Synthetic peptide
  Seed: RLLEFYLAMP (CTG1B_HUMAN)
RLLEFYLAML

SEQ ID NO: 29849 - protein, 9 aa, Artificial Sequence
  Description of Artificial Sequence: Synthetic peptide
  Seed: RLLEFYLAM (CTG1B_HUMAN)
RMLEFYLAW

SEQ ID NO: 29850 - protein, 9 aa, Artificial Sequence
  Description of Artificial Sequence: Synthetic peptide
  Seed: TPMEAELAR (CTG1B_HUMAN)
TPMEAELAI

SEQ ID NO: 29851 - protein, 9 aa, Artificial Sequence
  Description of Artificial Sequence: Synthetic peptide
  Seed: FATPMEAEL (CTG1B_HUMAN)
FPTPMEAEH

SEQ ID NO: 29852 - protein, 9 aa, Artificial Sequence
  Description of Artificial Sequence: Synthetic peptide
  Seed: AADHRQLQL (CTG1B_HUMAN)
AMDHRQLQV

SEQ ID NO: 29853 - protein, 9 aa, Artificial Sequence
  Description of Artificial Sequence: Synthetic peptide
  Seed: TVSGNILTI (CTG1B_HUMAN)
TESGNILTY

SEQ ID NO: 29854 - protein, 9 aa, Artificial Sequence
  Description of Artificial Sequence: Synthetic peptide
  Seed: LPVPGVLLK (CTG1B_HUMAN)
LIVPGVLLL

SEQ ID NO: 29855 - protein, 10 aa, Artificial Sequence
  Description of Artificial Sequence: Synthetic peptide
  Seed: RGPHGGAASG (CTG1B_HUMAN)
RIPHGGAASL

SEQ ID NO: 29856 - protein, 9 aa, Artificial Sequence
  Description of Artificial Sequence: Synthetic peptide
  Seed: LPVPGVLLK (CTG1B_HUMAN)
LPVPGVLLL

SEQ ID NO: 29857 - protein, 10 aa, Artificial Sequence
  Description of Artificial Sequence: Synthetic peptide
  Seed: LEFYLAMPFA (CTG1B_HUMAN)
LQFYLAMPFQ

SEQ ID NO: 29858 - protein, 10 aa, Artificial Sequence
  Description of Artificial Sequence: Synthetic peptide
  Seed: FYLAMPFATP (CTG1B_HUMAN)
FTLAMPFATT

SEQ ID NO: 29859 - protein, 9 aa, Artificial Sequence
  Description of Artificial Sequence: Synthetic peptide
  Seed: LAMPFATPM (CTG1B_HUMAN)
LSMPFATPL

SEQ ID NO: 29860 - protein, 9 aa, Artificial Sequence
  Description of Artificial Sequence: Synthetic peptide
  Seed: IPDGPGGNA (CTG1B_HUMAN)
IIDGPGGNM

SEQ ID NO: 29861 - protein, 10 aa, Artificial Sequence
  Description of Artificial Sequence: Synthetic peptide
  Seed: LLEFYLAMPF (CTG1B_HUMAN)
LREFYLAMPF

SEQ ID NO: 29862 - protein, 9 aa, Artificial Sequence
  Description of Artificial Sequence: Synthetic peptide
  Seed: LPVFLAQPP (CTG1B_HUMAN)
LAVFLAQPL

SEQ ID NO: 29863 - protein, 9 aa, Artificial Sequence
  Description of Artificial Sequence: Synthetic peptide
  Seed: LAMPFATPM (CTG1B_HUMAN)
LVMPFATPI

SEQ ID NO: 29864 - protein, 10 aa, Artificial Sequence
  Description of Artificial Sequence: Synthetic peptide
  Seed: YLAMPFATPM (CTG1B_HUMAN)
YFAMPFATPI

SEQ ID NO: 29865 - protein, 9 aa, Artificial Sequence
  Description of Artificial Sequence: Synthetic peptide
  Seed: FATPMEAEL (CTG1B_HUMAN)
FQTPMEAEM

SEQ ID NO: 29866 - protein, 11 aa, Artificial Sequence
  Description of Artificial Sequence: Synthetic peptide
  Seed: SLLMWITQCFL (CTG1B_HUMAN)
SELMWITQCFV

SEQ ID NO: 29867 - protein, 9 aa, Artificial Sequence
  Description of Artificial Sequence: Synthetic peptide
  Seed: TVSGNILTI (CTG1B_HUMAN)
TVSGNILTL

SEQ ID NO: 29868 - protein, 9 aa, Artificial Sequence
  Description of Artificial Sequence: Synthetic peptide
  Seed: MPFATPMEA (CTG1B_HUMAN)
MQFATPMEV

SEQ ID NO: 29869 - protein, 10 aa, Artificial Sequence
  Description of Artificial Sequence: Synthetic peptide
  Seed: SRLLEFYLAM (CTG1B_HUMAN)
SGLLEFYLAM

SEQ ID NO: 29870 - protein, 9 aa, Artificial Sequence
  Description of Artificial Sequence: Synthetic peptide
  Seed: AQDAPPLPV (CTG1B_HUMAN)
AMDAPPLPY

SEQ ID NO: 29871 - protein, 10 aa, Artificial Sequence
  Description of Artificial Sequence: Synthetic peptide
  Seed: EFTVSGNILT (CTG1B_HUMAN)
EPTVSGNILV

SEQ ID NO: 29872 - protein, 9 aa, Artificial Sequence
  Description of Artificial Sequence: Synthetic peptide
  Seed: ITQCFLPVF (CTG1B_HUMAN)
IYQCFLPVV

SEQ ID NO: 29873 - protein, 10 aa, Artificial Sequence
  Description of Artificial Sequence: Synthetic peptide
  Seed: FTVSGNILTI (CTG1B_HUMAN)
FQVSGNILTW

SEQ ID NO: 29874 - protein, 9 aa, Artificial Sequence
  Description of Artificial Sequence: Synthetic peptide
  Seed: RLLEFYLAM (CTG1B_HUMAN)
RALEFYLAK

SEQ ID NO: 29875 - protein, 9 aa, Artificial Sequence
  Description of Artificial Sequence: Synthetic peptide
  Seed: LEFYLAMPF (CTG1B_HUMAN)
LMFYLAMPF

SEQ ID NO: 29876 - protein, 10 aa, Artificial Sequence
  Description of Artificial Sequence: Synthetic peptide
  Seed: RGPRGAGAAR (CTG1B_HUMAN)
RTPRGAGAAR

SEQ ID NO: 29877 - protein, 10 aa, Artificial Sequence
  Description of Artificial Sequence: Synthetic peptide
  Seed: KEFTVSGNIL (CTG1B_HUMAN)
KEFTVSGNIT

SEQ ID NO: 29878 - protein, 10 aa, Artificial Sequence
  Description of Artificial Sequence: Synthetic peptide
  Seed: LMWITQCFLP (CTG1B_HUMAN)
LLWITQCFLL

SEQ ID NO: 29879 - protein, 11 aa, Artificial Sequence
  Description of Artificial Sequence: Synthetic peptide
  Seed: RLLEFYLAMPF (CTG1B_HUMAN)
RGLEFYLAMPY

SEQ ID NO: 29880 - protein, 10 aa, Artificial Sequence
  Description of Artificial Sequence: Synthetic peptide
  Seed: RQLQLSISSC (CTG1B_HUMAN)
RELQLSISSA

SEQ ID NO: 29881 - protein, 9 aa, Artificial Sequence
  Description of Artificial Sequence: Synthetic peptide
  Seed: SLAQDAPPL (CTG1B_HUMAN)
SVAQDAPPI

SEQ ID NO: 29882 - protein, 9 aa, Artificial Sequence
  Description of Artificial Sequence: Synthetic peptide
  Seed: SGPGGGAPR (CTG1B_HUMAN)
SSPGGGAPI

SEQ ID NO: 29883 - protein, 10 aa, Artificial Sequence
  Description of Artificial Sequence: Synthetic peptide
  Seed: EFTVSGNILT (CTG1B_HUMAN)
EWTVSGNILV

SEQ ID NO: 29884 - protein, 10 aa, Artificial Sequence
  Description of Artificial Sequence: Synthetic peptide
  Seed: MPFATPMEAE (CTG1B_HUMAN)
MAFATPMEAY

SEQ ID NO: 29885 - protein, 9 aa, Artificial Sequence
  Description of Artificial Sequence: Synthetic peptide
  Seed: LAMPFATPM (CTG1B_HUMAN)
LMMPFATPL

SEQ ID NO: 29886 - protein, 10 aa, Artificial Sequence
  Description of Artificial Sequence: Synthetic peptide
  Seed: SRLLEFYLAM (CTG1B_HUMAN)
SGLLEFYLAL

SEQ ID NO: 29887 - protein, 9 aa, Artificial Sequence
  Description of Artificial Sequence: Synthetic peptide
  Seed: RQLQLSISS (CTG1B_HUMAN)
RQLQLSISF

SEQ ID NO: 29888 - protein, 10 aa, Artificial Sequence
  Description of Artificial Sequence: Synthetic peptide
  Seed: SLLMWITQCF (CTG1B_HUMAN)
SNLMWITQCY

SEQ ID NO: 29889 - protein, 9 aa, Artificial Sequence
  Description of Artificial Sequence: Synthetic peptide
  Seed: AADHRQLQL (CTG1B_HUMAN)
ALDHRQLQI

SEQ ID NO: 29890 - protein, 9 aa, Artificial Sequence
  Description of Artificial Sequence: Synthetic peptide
  Seed: LAMPFATPM (CTG1B_HUMAN)
LAMPFATPI

SEQ ID NO: 29891 - protein, 9 aa, Artificial Sequence
  Description of Artificial Sequence: Synthetic peptide
  Seed: AELARRSLA (CTG1B_HUMAN)
AELARRSLF

SEQ ID NO: 29892 - protein, 10 aa, Artificial Sequence
  Description of Artificial Sequence: Synthetic peptide
  Seed: YLAMPFATPM (CTG1B_HUMAN)
YDAMPFATPA

SEQ ID NO: 29893 - protein, 9 aa, Artificial Sequence
  Description of Artificial Sequence: Synthetic peptide
  Seed: RLLEFYLAM (CTG1B_HUMAN)
RMLEFYLAH

SEQ ID NO: 29894 - protein, 10 aa, Artificial Sequence
  Description of Artificial Sequence: Synthetic peptide
  Seed: GAPRGPHGGA (CTG1B_HUMAN)
GQPRGPHGGM

SEQ ID NO: 29895 - protein, 11 aa, Artificial Sequence
  Description of Artificial Sequence: Synthetic peptide
  Seed: GPRGAGAARAS (CTG1B_HUMAN)
GPRGAGAARAL

SEQ ID NO: 29896 - protein, 9 aa, Artificial Sequence
  Description of Artificial Sequence: Synthetic peptide
  Seed: SISSCLQQL (CTG1B_HUMAN)
SVSSCLQQA

SEQ ID NO: 29897 - protein, 9 aa, Artificial Sequence
  Description of Artificial Sequence: Synthetic peptide
  Seed: AADHRQLQL (CTG1B_HUMAN)
ATDHRQLQL

SEQ ID NO: 29898 - protein, 10 aa, Artificial Sequence
  Description of Artificial Sequence: Synthetic peptide
  Seed: EFTVSGNILT (CTG1B_HUMAN)
EITVSGNILV

SEQ ID NO: 29899 - protein, 10 aa, Artificial Sequence
  Description of Artificial Sequence: Synthetic peptide
  Seed: SRLLEFYLAM (CTG1B_HUMAN)
SHLLEFYLAV

SEQ ID NO: 29900 - protein, 9 aa, Artificial Sequence
  Description of Artificial Sequence: Synthetic peptide
  Seed: LAMPFATPM (CTG1B_HUMAN)
LLMPFATPF

SEQ ID NO: 29901 - protein, 10 aa, Artificial Sequence
  Description of Artificial Sequence: Synthetic peptide
  Seed: SRLLEFYLAM (CTG1B_HUMAN)
SDLLEFYLAL

SEQ ID NO: 29902 - protein, 9 aa, Artificial Sequence
  Description of Artificial Sequence: Synthetic peptide
  Seed: LLKEFTVSG (CTG1B_HUMAN)
LMKEFTVST

SEQ ID NO: 29903 - protein, 11 aa, Artificial Sequence
  Description of Artificial Sequence: Synthetic peptide
  Seed: RASGPGGGAPR (CTG1B_HUMAN)
RPSGPGGGAPT

SEQ ID NO: 29904 - protein, 10 aa, Artificial Sequence
  Description of Artificial Sequence: Synthetic peptide
  Seed: FTVSGNILTI (CTG1B_HUMAN)
FLVSGNILTV

SEQ ID NO: 29905 - protein, 9 aa, Artificial Sequence
  Description of Artificial Sequence: Synthetic peptide
  Seed: LAMPFATPM (CTG1B_HUMAN)
LGMPFATPF

SEQ ID NO: 29906 - protein, 10 aa, Artificial Sequence
  Description of Artificial Sequence: Synthetic peptide
  Seed: AMPFATPMEA (CTG1B_HUMAN)
AWPFATPMEM

SEQ ID NO: 29907 - protein, 10 aa, Artificial Sequence
  Description of Artificial Sequence: Synthetic peptide
  Seed: EFTVSGNILT (CTG1B_HUMAN)
EVTVSGNILI

SEQ ID NO: 29908 - protein, 9 aa, Artificial Sequence
  Description of Artificial Sequence: Synthetic peptide
  Seed: MQAEGRGTG (CTG1B_HUMAN)
MQAEGRGTY

SEQ ID NO: 29909 - protein, 10 aa, Artificial Sequence
  Description of Artificial Sequence: Synthetic peptide
  Seed: RGPESRLLEF (CTG1B_HUMAN)
RFPESRLLEL

SEQ ID NO: 29910 - protein, 10 aa, Artificial Sequence
  Description of Artificial Sequence: Synthetic peptide
  Seed: RSLAQDAPPL (CTG1B_HUMAN)
RLLAQDAPPI

SEQ ID NO: 29911 - protein, 9 aa, Artificial Sequence
  Description of Artificial Sequence: Synthetic peptide
  Seed: AARASGPGG (CTG1B_HUMAN)
AMRASGPGI

SEQ ID NO: 29912 - protein, 10 aa, Artificial Sequence
  Description of Artificial Sequence: Synthetic peptide
  Seed: FTVSGNILTI (CTG1B_HUMAN)
FIVSGNILTI

SEQ ID NO: 29913 - protein, 10 aa, Artificial Sequence
  Description of Artificial Sequence: Synthetic peptide
  Seed: RGPHGGAASG (CTG1B_HUMAN)
RNPHGGAASV

SEQ ID NO: 29914 - protein, 10 aa, Artificial Sequence
  Description of Artificial Sequence: Synthetic peptide
  Seed: YLAMPFATPM (CTG1B_HUMAN)
YKAMPFATPM

SEQ ID NO: 29915 - protein, 9 aa, Artificial Sequence
  Description of Artificial Sequence: Synthetic peptide
  Seed: AQDAPPLPV (CTG1B_HUMAN)
AYDAPPLPV

SEQ ID NO: 29916 - protein, 10 aa, Artificial Sequence
  Description of Artificial Sequence: Synthetic peptide
  Seed: ITQCFLPVFL (CTG1B_HUMAN)
ISQCFLPVFW

SEQ ID NO: 29917 - protein, 10 aa, Artificial Sequence
  Description of Artificial Sequence: Synthetic peptide
  Seed: FYLAMPFATP (CTG1B_HUMAN)
FPLAMPFATV

SEQ ID NO: 29918 - protein, 9 aa, Artificial Sequence
  Description of Artificial Sequence: Synthetic peptide
  Seed: LLMWITQCF (CTG1B_HUMAN)
LQMWITQCI

SEQ ID NO: 29919 - protein, 10 aa, Artificial Sequence
  Description of Artificial Sequence: Synthetic peptide
  Seed: FTVSGNILTI (CTG1B_HUMAN)
FTVSGNILTY

SEQ ID NO: 29920 - protein, 9 aa, Artificial Sequence
  Description of Artificial Sequence: Synthetic peptide
  Seed: SISSCLQQL (CTG1B_HUMAN)
STSSCLQQF

SEQ ID NO: 29921 - protein, 10 aa, Artificial Sequence
  Description of Artificial Sequence: Synthetic peptide
  Seed: FYLAMPFATP (CTG1B_HUMAN)
FSLAMPFATL

SEQ ID NO: 29922 - protein, 9 aa, Artificial Sequence
  Description of Artificial Sequence: Synthetic peptide
  Seed: LMWITQCFL (CTG1B_HUMAN)
LQWITQCFF

SEQ ID NO: 29923 - protein, 9 aa, Artificial Sequence
  Description of Artificial Sequence: Synthetic peptide
  Seed: TVSGNILTI (CTG1B_HUMAN)
TPSGNILTV

SEQ ID NO: 29924 - protein, 11 aa, Artificial Sequence
  Description of Artificial Sequence: Synthetic peptide
  Seed: RLLEFYLAMPF (CTG1B_HUMAN)
RDLEFYLAMPV

SEQ ID NO: 29925 - protein, 9 aa, Artificial Sequence
  Description of Artificial Sequence: Synthetic peptide
  Seed: SISSCLQQL (CTG1B_HUMAN)
SVSSCLQQF

SEQ ID NO: 29926 - protein, 9 aa, Artificial Sequence
  Description of Artificial Sequence: Synthetic peptide
  Seed: AADHRQLQL (CTG1B_HUMAN)
AWDHRQLQI

SEQ ID NO: 29927 - protein, 9 aa, Artificial Sequence
  Description of Artificial Sequence: Synthetic peptide
  Seed: DHRQLQLSI (CTG1B_HUMAN)
DHRQLQLSA

SEQ ID NO: 29928 - protein, 9 aa, Artificial Sequence
  Description of Artificial Sequence: Synthetic peptide
  Seed: TVSGNILTI (CTG1B_HUMAN)
TFSGNILTF

SEQ ID NO: 29929 - protein, 10 aa, Artificial Sequence
  Description of Artificial Sequence: Synthetic peptide
  Seed: AMPFATPMEA (CTG1B_HUMAN)
AHPFATPMEF

SEQ ID NO: 29930 - protein, 11 aa, Artificial Sequence
  Description of Artificial Sequence: Synthetic peptide
  Seed: GEAGATGGRGP (CTG1B_HUMAN)
GEAGATGGRGA

SEQ ID NO: 29931 - protein, 9 aa, Artificial Sequence
  Description of Artificial Sequence: Synthetic peptide
  Seed: FATPMEAEL (CTG1B_HUMAN)
FPTPMEAEW

SEQ ID NO: 29932 - protein, 10 aa, Artificial Sequence
  Description of Artificial Sequence: Synthetic peptide
  Seed: YLAMPFATPM (CTG1B_HUMAN)
YSAMPFATPW

SEQ ID NO: 29933 - protein, 10 aa, Artificial Sequence
  Description of Artificial Sequence: Synthetic peptide
  Seed: YLAMPFATPM (CTG1B_HUMAN)
YRAMPFATPL

SEQ ID NO: 29934 - protein, 9 aa, Artificial Sequence
  Description of Artificial Sequence: Synthetic peptide
  Seed: YLAMPFATP (CTG1B_HUMAN)
YMAMPFATV

SEQ ID NO: 29935 - protein, 10 aa, Artificial Sequence
  Description of Artificial Sequence: Synthetic peptide
  Seed: KEFTVSGNIL (CTG1B_HUMAN)
KKFTVSGNIY

SEQ ID NO: 29936 - protein, 10 aa, Artificial Sequence
  Description of Artificial Sequence: Synthetic peptide
  Seed: RGPHGGAASG (CTG1B_HUMAN)
RIPHGGAASA

SEQ ID NO: 29937 - protein, 10 aa, Artificial Sequence
  Description of Artificial Sequence: Synthetic peptide
  Seed: FLPVFLAQPP (CTG1B_HUMAN)
FKPVFLAQPT

SEQ ID NO: 29938 - protein, 10 aa, Artificial Sequence
  Description of Artificial Sequence: Synthetic peptide
  Seed: LLEFYLAMPF (CTG1B_HUMAN)
LWEFYLAMPY

SEQ ID NO: 29939 - protein, 11 aa, Artificial Sequence
  Description of Artificial Sequence: Synthetic peptide
  Seed: RLLEFYLAMPF (CTG1B_HUMAN)
RNLEFYLAMPL

SEQ ID NO: 29940 - protein, 10 aa, Artificial Sequence
  Description of Artificial Sequence: Synthetic peptide
  Seed: YLAMPFATPM (CTG1B_HUMAN)
YLAMPFATPL

SEQ ID NO: 29941 - protein, 10 aa, Artificial Sequence
  Description of Artificial Sequence: Synthetic peptide
  Seed: LLMWITQCFL (CTG1B_HUMAN)
LFMWITQCFV

SEQ ID NO: 29942 - protein, 8 aa, Artificial Sequence
  Description of Artificial Sequence: Synthetic peptide
  Seed: EFYLAMPF (CTG1B_HUMAN)
EEYLAMPY

SEQ ID NO: 29943 - protein, 10 aa, Artificial Sequence
  Description of Artificial Sequence: Synthetic peptide
  Seed: FYLAMPFATP (CTG1B_HUMAN)
FCLAMPFATL

SEQ ID NO: 29944 - protein, 10 aa, Artificial Sequence
  Description of Artificial Sequence: Synthetic peptide
  Seed: FYLAMPFATP (CTG1B_HUMAN)
FDLAMPFATM

SEQ ID NO: 29945 - protein, 10 aa, Artificial Sequence
  Description of Artificial Sequence: Synthetic peptide
  Seed: FLPVFLAQPP (CTG1B_HUMAN)
FEPVFLAQPT

SEQ ID NO: 29946 - protein, 9 aa, Artificial Sequence
  Description of Artificial Sequence: Synthetic peptide
  Seed: FLPVFLAQP (CTG1B_HUMAN)
FQPVFLAQM

SEQ ID NO: 29947 - protein, 9 aa, Artificial Sequence
  Description of Artificial Sequence: Synthetic peptide
  Seed: IPDGPGGNA (CTG1B_HUMAN)
INDGPGGNM

SEQ ID NO: 29948 - protein, 9 aa, Artificial Sequence
  Description of Artificial Sequence: Synthetic peptide
  Seed: NGCCRCGAR (CTG1B_HUMAN)
NTCCRCGAR

SEQ ID NO: 29949 - protein, 10 aa, Artificial Sequence
  Description of Artificial Sequence: Synthetic peptide
  Seed: RGPHGGAASG (CTG1B_HUMAN)
RIPHGGAASM

SEQ ID NO: 29950 - protein, 9 aa, Artificial Sequence
  Description of Artificial Sequence: Synthetic peptide
  Seed: LEFYLAMPF (CTG1B_HUMAN)
LMFYLAMPA

SEQ ID NO: 29951 - protein, 9 aa, Artificial Sequence
  Description of Artificial Sequence: Synthetic peptide
  Seed: LQQLSLLMW (CTG1B_HUMAN)
LQQLSLLMF

SEQ ID NO: 29952 - protein, 9 aa, Artificial Sequence
  Description of Artificial Sequence: Synthetic peptide
  Seed: RLLEFYLAM (CTG1B_HUMAN)
RVLEFYLAF

SEQ ID NO: 29953 - protein, 9 aa, Artificial Sequence
  Description of Artificial Sequence: Synthetic peptide
  Seed: LTAADHRQL (CTG1B_HUMAN)
LAAADHRQY

SEQ ID NO: 29954 - protein, 11 aa, Artificial Sequence
  Description of Artificial Sequence: Synthetic peptide
  Seed: SLLMWITQCFL (CTG1B_HUMAN)
SVLMWITQCFV

SEQ ID NO: 29955 - protein, 10 aa, Artificial Sequence
  Description of Artificial Sequence: Synthetic peptide
  Seed: FLPVFLAQPP (CTG1B_HUMAN)
FMPVFLAQPI

SEQ ID NO: 29956 - protein, 10 aa, Artificial Sequence
  Description of Artificial Sequence: Synthetic peptide
  Seed: YLAMPFATPM (CTG1B_HUMAN)
YAAMPFATPL

SEQ ID NO: 29957 - protein, 9 aa, Artificial Sequence
  Description of Artificial Sequence: Synthetic peptide
  Seed: TQCFLPVFL (CTG1B_HUMAN)
THCFLPVFF

SEQ ID NO: 29958 - protein, 9 aa, Artificial Sequence
  Description of Artificial Sequence: Synthetic peptide
  Seed: FTVSGNILT (CTG1B_HUMAN)
FTVSGNILL

SEQ ID NO: 29959 - protein, 9 aa, Artificial Sequence
  Description of Artificial Sequence: Synthetic peptide
  Seed: RLLEFYLAM (CTG1B_HUMAN)
RTLEFYLAA

SEQ ID NO: 29960 - protein, 10 aa, Artificial Sequence
  Description of Artificial Sequence: Synthetic peptide
  Seed: FYLAMPFATP (CTG1B_HUMAN)
FGLAMPFATL

SEQ ID NO: 29961 - protein, 10 aa, Artificial Sequence
  Description of Artificial Sequence: Synthetic peptide
  Seed: ISSCLQQLSL (CTG1B_HUMAN)
IFSCLQQLSW

SEQ ID NO: 29962 - protein, 10 aa, Artificial Sequence
  Description of Artificial Sequence: Synthetic peptide
  Seed: MWITQCFLPV (CTG1B_HUMAN)
MVITQCFLPL

SEQ ID NO: 29963 - protein, 10 aa, Artificial Sequence
  Description of Artificial Sequence: Synthetic peptide
  Seed: TVSGNILTIR (CTG1B_HUMAN)
TISGNILTIK

SEQ ID NO: 29964 - protein, 9 aa, Artificial Sequence
  Description of Artificial Sequence: Synthetic peptide
  Seed: YLAMPFATP (CTG1B_HUMAN)
YLAMPFATM

SEQ ID NO: 29965 - protein, 9 aa, Artificial Sequence
  Description of Artificial Sequence: Synthetic peptide
  Seed: LMWITQCFL (CTG1B_HUMAN)
LIWITQCFI

SEQ ID NO: 29966 - protein, 11 aa, Artificial Sequence
  Description of Artificial Sequence: Synthetic peptide
  Seed: RLLEFYLAMPF (CTG1B_HUMAN)
RHLEFYLAMPF

SEQ ID NO: 29967 - protein, 10 aa, Artificial Sequence
  Description of Artificial Sequence: Synthetic peptide
  Seed: EFTVSGNILT (CTG1B_HUMAN)
EETVSGNILI

SEQ ID NO: 29968 - protein, 9 aa, Artificial Sequence
  Description of Artificial Sequence: Synthetic peptide
  Seed: YLAMPFATP (CTG1B_HUMAN)
YMAMPFATG

SEQ ID NO: 29969 - protein, 10 aa, Artificial Sequence
  Description of Artificial Sequence: Synthetic peptide
  Seed: LEFYLAMPFA (CTG1B_HUMAN)
LQFYLAMPFI

SEQ ID NO: 29970 - protein, 10 aa, Artificial Sequence
  Description of Artificial Sequence: Synthetic peptide
  Seed: ASGPGGGAPR (CTG1B_HUMAN)
ASGPGGGAPK

SEQ ID NO: 29971 - protein, 9 aa, Artificial Sequence
  Description of Artificial Sequence: Synthetic peptide
  Seed: SGPGGGAPR (CTG1B_HUMAN)
STPGGGAPV

SEQ ID NO: 29972 - protein, 10 aa, Artificial Sequence
  Description of Artificial Sequence: Synthetic peptide
  Seed: RLLEFYLAMP (CTG1B_HUMAN)
RHLEFYLAMV

SEQ ID NO: 29973 - protein, 10 aa, Artificial Sequence
  Description of Artificial Sequence: Synthetic peptide
  Seed: SLLMWITQCF (CTG1B_HUMAN)
SALMWITQCY

SEQ ID NO: 29974 - protein, 9 aa, Artificial Sequence
  Description of Artificial Sequence: Synthetic peptide
  Seed: SLLMWITQC (CTG1B_HUMAN)
SLLMWITQA

SEQ ID NO: 29975 - protein, 9 aa, Artificial Sequence
  Description of Artificial Sequence: Synthetic peptide
  Seed: GVLLKEFTV (CTG1B_HUMAN)
GQLLKEFTI

SEQ ID NO: 29976 - protein, 11 aa, Artificial Sequence
  Description of Artificial Sequence: Synthetic peptide
  Seed: SSCLQQLSLLM (CTG1B_HUMAN)
SSCLQQLSLLF

SEQ ID NO: 29977 - protein, 9 aa, Artificial Sequence
  Description of Artificial Sequence: Synthetic peptide
  Seed: FATPMEAEL (CTG1B_HUMAN)
FSTPMEAEV

SEQ ID NO: 29978 - protein, 9 aa, Artificial Sequence
  Description of Artificial Sequence: Synthetic peptide
  Seed: CLQQLSLLM (CTG1B_HUMAN)
CMQQLSLLI

SEQ ID NO: 29979 - protein, 9 aa, Artificial Sequence
  Description of Artificial Sequence: Synthetic peptide
  Seed: LAMPFATPM (CTG1B_HUMAN)
LQMPFATPA

SEQ ID NO: 29980 - protein, 11 aa, Artificial Sequence
  Description of Artificial Sequence: Synthetic peptide
  Seed: RASGPGGGAPR (CTG1B_HUMAN)
RMSGPGGGAPR

SEQ ID NO: 29981 - protein, 10 aa, Artificial Sequence
  Description of Artificial Sequence: Synthetic peptide
  Seed: SRLLEFYLAM (CTG1B_HUMAN)
SLLLEFYLAA

SEQ ID NO: 29982 - protein, 10 aa, Artificial Sequence
  Description of Artificial Sequence: Synthetic peptide
  Seed: SRLLEFYLAM (CTG1B_HUMAN)
SDLLEFYLAA

SEQ ID NO: 29983 - protein, 9 aa, Artificial Sequence
  Description of Artificial Sequence: Synthetic peptide
  Seed: FLPVFLAQP (CTG1B_HUMAN)
FLPVFLAQM

SEQ ID NO: 29984 - protein, 9 aa, Artificial Sequence
  Description of Artificial Sequence: Synthetic peptide
  Seed: LAMPFATPM (CTG1B_HUMAN)
LTMPFATPV

SEQ ID NO: 29985 - protein, 10 aa, Artificial Sequence
  Description of Artificial Sequence: Synthetic peptide
  Seed: FYLAMPFATP (CTG1B_HUMAN)
FILAMPFATT

SEQ ID NO: 29986 - protein, 10 aa, Artificial Sequence
  Description of Artificial Sequence: Synthetic peptide
  Seed: FYLAMPFATP (CTG1B_HUMAN)
FVLAMPFATM

SEQ ID NO: 29987 - protein, 9 aa, Artificial Sequence
  Description of Artificial Sequence: Synthetic peptide
  Seed: MQAEGRGTG (CTG1B_HUMAN)
MMAEGRGTM

SEQ ID NO: 29988 - protein, 11 aa, Artificial Sequence
  Description of Artificial Sequence: Synthetic peptide
  Seed: RLLEFYLAMPF (CTG1B_HUMAN)
RVLEFYLAMPI

SEQ ID NO: 29989 - protein, 10 aa, Artificial Sequence
  Description of Artificial Sequence: Synthetic peptide
  Seed: GIPDGPGGNA (CTG1B_HUMAN)
GAPDGPGGNF

SEQ ID NO: 29990 - protein, 10 aa, Artificial Sequence
  Description of Artificial Sequence: Synthetic peptide
  Seed: IPDGPGGNAG (CTG1B_HUMAN)
IVDGPGGNAY

SEQ ID NO: 29991 - protein, 9 aa, Artificial Sequence
  Description of Artificial Sequence: Synthetic peptide
  Seed: ASGPGGGAP (CTG1B_HUMAN)
AVGPGGGAF

SEQ ID NO: 29992 - protein, 11 aa, Artificial Sequence
  Description of Artificial Sequence: Synthetic peptide
  Seed: RQLQLSISSCL (CTG1B_HUMAN)
RRLQLSISSCF

SEQ ID NO: 29993 - protein, 9 aa, Artificial Sequence
  Description of Artificial Sequence: Synthetic peptide
  Seed: MPFATPMEA (CTG1B_HUMAN)
MDFATPMEY

SEQ ID NO: 29994 - protein, 9 aa, Artificial Sequence
  Description of Artificial Sequence: Synthetic peptide
  Seed: LEFYLAMPF (CTG1B_HUMAN)
LFFYLAMPF

SEQ ID NO: 29995 - protein, 9 aa, Artificial Sequence
  Description of Artificial Sequence: Synthetic peptide
  Seed: SLAQDAPPL (CTG1B_HUMAN)
SQAQDAPPI

SEQ ID NO: 29996 - protein, 9 aa, Artificial Sequence
  Description of Artificial Sequence: Synthetic peptide
  Seed: SSCLQQLSL (CTG1B_HUMAN)
SRCLQQLSM

SEQ ID NO: 29997 - protein, 11 aa, Artificial Sequence
  Description of Artificial Sequence: Synthetic peptide
  Seed: RLLEFYLAMPF (CTG1B_HUMAN)
RLLEFYLAMPI

SEQ ID NO: 29998 - protein, 9 aa, Artificial Sequence
  Description of Artificial Sequence: Synthetic peptide
  Seed: LLMWITQCF (CTG1B_HUMAN)
LFMWITQCY

SEQ ID NO: 29999 - protein, 9 aa, Artificial Sequence
  Description of Artificial Sequence: Synthetic peptide
  Seed: LQQLSLLMW (CTG1B_HUMAN)
LVQLSLLMW

SEQ ID NO: 30000 - protein, 9 aa, Artificial Sequence
  Description of Artificial Sequence: Synthetic peptide
  Seed: LAMPFATPM (CTG1B_HUMAN)
LAMPFATPK

SEQ ID NO: 30001 - protein, 9 aa, Artificial Sequence
  Description of Artificial Sequence: Synthetic peptide
  Seed: SLLMWITQC (CTG1B_HUMAN)
SQLMWITQI

SEQ ID NO: 30002 - protein, 9 aa, Artificial Sequence
  Description of Artificial Sequence: Synthetic peptide
  Seed: LQLSISSCL (CTG1B_HUMAN)
LMLSISSCV

SEQ ID NO: 30003 - protein, 9 aa, Artificial Sequence
  Description of Artificial Sequence: Synthetic peptide
  Seed: FTVSGNILT (CTG1B_HUMAN)
FQVSGNILA

SEQ ID NO: 30004 - protein, 11 aa, Artificial Sequence
  Description of Artificial Sequence: Synthetic peptide
  Seed: RASGPGGGAPR (CTG1B_HUMAN)
RGSGPGGGAPY

SEQ ID NO: 30005 - protein, 9 aa, Artificial Sequence
  Description of Artificial Sequence: Synthetic peptide
  Seed: CLQQLSLLM (CTG1B_HUMAN)
CMQQLSLLL

SEQ ID NO: 30006 - protein, 10 aa, Artificial Sequence
  Description of Artificial Sequence: Synthetic peptide
  Seed: MPFATPMEAE (CTG1B_HUMAN)
MAFATPMEAF

SEQ ID NO: 30007 - protein, 9 aa, Artificial Sequence
  Description of Artificial Sequence: Synthetic peptide
  Seed: ADGPGGPGI (CTG1B_HUMAN)
AEGPGGPGI

SEQ ID NO: 30008 - protein, 11 aa, Artificial Sequence
  Description of Artificial Sequence: Synthetic peptide
  Seed: GAPRGPHGGAA (CTG1B_HUMAN)
GLPRGPHGGAL

SEQ ID NO: 30009 - protein, 9 aa, Artificial Sequence
  Description of Artificial Sequence: Synthetic peptide
  Seed: LAMPFATPM (CTG1B_HUMAN)
LSMPFATPA

SEQ ID NO: 30010 - protein, 10 aa, Artificial Sequence
  Description of Artificial Sequence: Synthetic peptide
  Seed: MPFATPMEAE (CTG1B_HUMAN)
MPFATPMEAC

SEQ ID NO: 30011 - protein, 10 aa, Artificial Sequence
  Description of Artificial Sequence: Synthetic peptide
  Seed: RSLAQDAPPL (CTG1B_HUMAN)
RTLAQDAPPY

SEQ ID NO: 30012 - protein, 11 aa, Artificial Sequence
  Description of Artificial Sequence: Synthetic peptide
  Seed: ARGPESRLLEF (CTG1B_HUMAN)
AQGPESRLLEY

SEQ ID NO: 30013 - protein, 10 aa, Artificial Sequence
  Description of Artificial Sequence: Synthetic peptide
  Seed: FYLAMPFATP (CTG1B_HUMAN)
FMLAMPFATA

SEQ ID NO: 30014 - protein, 9 aa, Artificial Sequence
  Description of Artificial Sequence: Synthetic peptide
  Seed: RQLQLSISS (CTG1B_HUMAN)
RGLQLSISF

SEQ ID NO: 30015 - protein, 10 aa, Artificial Sequence
  Description of Artificial Sequence: Synthetic peptide
  Seed: YLAMPFATPM (CTG1B_HUMAN)
YQAMPFATPY

SEQ ID NO: 30016 - protein, 9 aa, Artificial Sequence
  Description of Artificial Sequence: Synthetic peptide
  Seed: RQLQLSISS (CTG1B_HUMAN)
RMLQLSISL

SEQ ID NO: 30017 - protein, 10 aa, Artificial Sequence
  Description of Artificial Sequence: Synthetic peptide
  Seed: LLEFYLAMPF (CTG1B_HUMAN)
LEEFYLAMPY

SEQ ID NO: 30018 - protein, 9 aa, Artificial Sequence
  Description of Artificial Sequence: Synthetic peptide
  Seed: LPVFLAQPP (CTG1B_HUMAN)
LVVFLAQPF

SEQ ID NO: 30019 - protein, 10 aa, Artificial Sequence
  Description of Artificial Sequence: Synthetic peptide
  Seed: ISSCLQQLSL (CTG1B_HUMAN)
ITSCLQQLSF

SEQ ID NO: 30020 - protein, 11 aa, Artificial Sequence
  Description of Artificial Sequence: Synthetic peptide
  Seed: RLLEFYLAMPF (CTG1B_HUMAN)
RALEFYLAMPF

SEQ ID NO: 30021 - protein, 11 aa, Artificial Sequence
  Description of Artificial Sequence: Synthetic peptide
  Seed: RLLEFYLAMPF (CTG1B_HUMAN)
RQLEFYLAMPW

SEQ ID NO: 30022 - protein, 10 aa, Artificial Sequence
  Description of Artificial Sequence: Synthetic peptide
  Seed: FYLAMPFATP (CTG1B_HUMAN)
FKLAMPFATA

SEQ ID NO: 30023 - protein, 11 aa, Artificial Sequence
  Description of Artificial Sequence: Synthetic peptide
  Seed: RQLQLSISSCL (CTG1B_HUMAN)
RHLQLSISSCF

SEQ ID NO: 30024 - protein, 9 aa, Artificial Sequence
  Description of Artificial Sequence: Synthetic peptide
  Seed: AQDAPPLPV (CTG1B_HUMAN)
ATDAPPLPV

SEQ ID NO: 30025 - protein, 11 aa, Artificial Sequence
  Description of Artificial Sequence: Synthetic peptide
  Seed: LTAADHRQLQL (CTG1B_HUMAN)
LIAADHRQLQW

SEQ ID NO: 30026 - protein, 9 aa, Artificial Sequence
  Description of Artificial Sequence: Synthetic peptide
  Seed: SSCLQQLSL (CTG1B_HUMAN)
SECLQQLSF

SEQ ID NO: 30027 - protein, 9 aa, Artificial Sequence
  Description of Artificial Sequence: Synthetic peptide
  Seed: AQDAPPLPV (CTG1B_HUMAN)
AYDAPPLPF

SEQ ID NO: 30028 - protein, 9 aa, Artificial Sequence
  Description of Artificial Sequence: Synthetic peptide
  Seed: LEFYLAMPF (CTG1B_HUMAN)
LPFYLAMPW

SEQ ID NO: 30029 - protein, 9 aa, Artificial Sequence
  Description of Artificial Sequence: Synthetic peptide
  Seed: SISSCLQQL (CTG1B_HUMAN)
SSSSCLQQM

SEQ ID NO: 30030 - protein, 9 aa, Artificial Sequence
  Description of Artificial Sequence: Synthetic peptide
  Seed: SGPGGGAPR (CTG1B_HUMAN)
SSPGGGAPL

SEQ ID NO: 30031 - protein, 10 aa, Artificial Sequence
  Description of Artificial Sequence: Synthetic peptide
  Seed: EFTVSGNILT (CTG1B_HUMAN)
ERTVSGNILV

SEQ ID NO: 30032 - protein, 9 aa, Artificial Sequence
  Description of Artificial Sequence: Synthetic peptide
  Seed: LTAADHRQL (CTG1B_HUMAN)
LQAADHRQI

SEQ ID NO: 30033 - protein, 9 aa, Artificial Sequence
  Description of Artificial Sequence: Synthetic peptide
  Seed: QDAPPLPVP (CTG1B_HUMAN)
QEAPPLPVA

SEQ ID NO: 30034 - protein, 10 aa, Artificial Sequence
  Description of Artificial Sequence: Synthetic peptide
  Seed: LQQLSLLMWI (CTG1B_HUMAN)
LYQLSLLMWV

SEQ ID NO: 30035 - protein, 10 aa, Artificial Sequence
  Description of Artificial Sequence: Synthetic peptide
  Seed: FYLAMPFATP (CTG1B_HUMAN)
FRLAMPFATT

SEQ ID NO: 30036 - protein, 11 aa, Artificial Sequence
  Description of Artificial Sequence: Synthetic peptide
  Seed: FYLAMPFATPM (CTG1B_HUMAN)
FLLAMPFATPY

SEQ ID NO: 30037 - protein, 9 aa, Artificial Sequence
  Description of Artificial Sequence: Synthetic peptide
  Seed: DAPPLPVPG (CTG1B_HUMAN)
DSPPLPVPV

SEQ ID NO: 30038 - protein, 10 aa, Artificial Sequence
  Description of Artificial Sequence: Synthetic peptide
  Seed: FTVSGNILTI (CTG1B_HUMAN)
FMVSGNILTW

SEQ ID NO: 30039 - protein, 10 aa, Artificial Sequence
  Description of Artificial Sequence: Synthetic peptide
  Seed: ASGPGGGAPR (CTG1B_HUMAN)
AVGPGGGAPL

SEQ ID NO: 30040 - protein, 9 aa, Artificial Sequence
  Description of Artificial Sequence: Synthetic peptide
  Seed: AARASGPGG (CTG1B_HUMAN)
AVRASGPGA

SEQ ID NO: 30041 - protein, 11 aa, Artificial Sequence
  Description of Artificial Sequence: Synthetic peptide
  Seed: FYLAMPFATPM (CTG1B_HUMAN)
FALAMPFATPM

SEQ ID NO: 30042 - protein, 9 aa, Artificial Sequence
  Description of Artificial Sequence: Synthetic peptide
  Seed: AADHRQLQL (CTG1B_HUMAN)
AGDHRQLQL

SEQ ID NO: 30043 - protein, 9 aa, Artificial Sequence
  Description of Artificial Sequence: Synthetic peptide
  Seed: IPDGPGGNA (CTG1B_HUMAN)
IQDGPGGNM

SEQ ID NO: 30044 - protein, 9 aa, Artificial Sequence
  Description of Artificial Sequence: Synthetic peptide
  Seed: SSCLQQLSL (CTG1B_HUMAN)
SQCLQQLSV

SEQ ID NO: 30045 - protein, 10 aa, Artificial Sequence
  Description of Artificial Sequence: Synthetic peptide
  Seed: ASGPGGGAPR (CTG1B_HUMAN)
ATGPGGGAPF

SEQ ID NO: 30046 - protein, 9 aa, Artificial Sequence
  Description of Artificial Sequence: Synthetic peptide
  Seed: LAMPFATPM (CTG1B_HUMAN)
LYMPFATPW

SEQ ID NO: 30047 - protein, 9 aa, Artificial Sequence
  Description of Artificial Sequence: Synthetic peptide
  Seed: YLAMPFATP (CTG1B_HUMAN)
YSAMPFATL

SEQ ID NO: 30048 - protein, 9 aa, Artificial Sequence
  Description of Artificial Sequence: Synthetic peptide
  Seed: ASGPGGGAP (CTG1B_HUMAN)
AIGPGGGAY

SEQ ID NO: 30049 - protein, 9 aa, Artificial Sequence
  Description of Artificial Sequence: Synthetic peptide
  Seed: SSCLQQLSL (CTG1B_HUMAN)
SQCLQQLSY

SEQ ID NO: 30050 - protein, 9 aa, Artificial Sequence
  Description of Artificial Sequence: Synthetic peptide
  Seed: LMWITQCFL (CTG1B_HUMAN)
LLWITQCFA

SEQ ID NO: 30051 - protein, 9 aa, Artificial Sequence
  Description of Artificial Sequence: Synthetic peptide
  Seed: LTAADHRQL (CTG1B_HUMAN)
LTAADHRQW

SEQ ID NO: 30052 - protein, 10 aa, Artificial Sequence
  Description of Artificial Sequence: Synthetic peptide
  Seed: EFTVSGNILT (CTG1B_HUMAN)
EYTVSGNILV

SEQ ID NO: 30053 - protein, 9 aa, Artificial Sequence
  Description of Artificial Sequence: Synthetic peptide
  Seed: RLLEFYLAM (CTG1B_HUMAN)
RGLEFYLAR

SEQ ID NO: 30054 - protein, 9 aa, Artificial Sequence
  Description of Artificial Sequence: Synthetic peptide
  Seed: MPFATPMEA (CTG1B_HUMAN)
MLFATPMEF

SEQ ID NO: 30055 - protein, 9 aa, Artificial Sequence
  Description of Artificial Sequence: Synthetic peptide
  Seed: TQCFLPVFL (CTG1B_HUMAN)
TECFLPVFL

SEQ ID NO: 30056 - protein, 9 aa, Artificial Sequence
  Description of Artificial Sequence: Synthetic peptide
  Seed: LLKEFTVSG (CTG1B_HUMAN)
LQKEFTVSI

SEQ ID NO: 30057 - protein, 9 aa, Artificial Sequence
  Description of Artificial Sequence: Synthetic peptide
  Seed: TPMEAELAR (CTG1B_HUMAN)
TSMEAELAY

SEQ ID NO: 30058 - protein, 9 aa, Artificial Sequence
  Description of Artificial Sequence: Synthetic peptide
  Seed: LQQLSLLMW (CTG1B_HUMAN)
LMQLSLLMM

SEQ ID NO: 30059 - protein, 9 aa, Artificial Sequence
  Description of Artificial Sequence: Synthetic peptide
  Seed: AARASGPGG (CTG1B_HUMAN)
AYRASGPGI

SEQ ID NO: 30060 - protein, 9 aa, Artificial Sequence
  Description of Artificial Sequence: Synthetic peptide
  Seed: QQLSLLMWI (CTG1B_HUMAN)
QQLSLLMWM

SEQ ID NO: 30061 - protein, 11 aa, Artificial Sequence
  Description of Artificial Sequence: Synthetic peptide
  Seed: LLMWITQCFLP (CTG1B_HUMAN)
LLMWITQCFLL

SEQ ID NO: 30062 - protein, 9 aa, Artificial Sequence
  Description of Artificial Sequence: Synthetic peptide
  Seed: LAQPPSGQR (CTG1B_HUMAN)
LTQPPSGQR

SEQ ID NO: 30063 - protein, 11 aa, Artificial Sequence
  Description of Artificial Sequence: Synthetic peptide
  Seed: RLLEFYLAMPF (CTG1B_HUMAN)
RNLEFYLAMPY

SEQ ID NO: 30064 - protein, 10 aa, Artificial Sequence
  Description of Artificial Sequence: Synthetic peptide
  Seed: YLAMPFATPM (CTG1B_HUMAN)
YGAMPFATPM

SEQ ID NO: 30065 - protein, 9 aa, Artificial Sequence
  Description of Artificial Sequence: Synthetic peptide
  Seed: SGPGGGAPR (CTG1B_HUMAN)
SRPGGGAPF

SEQ ID NO: 30066 - protein, 11 aa, Artificial Sequence
  Description of Artificial Sequence: Synthetic peptide
  Seed: RLLEFYLAMPF (CTG1B_HUMAN)
RKLEFYLAMPV

SEQ ID NO: 30067 - protein, 10 aa, Artificial Sequence
  Description of Artificial Sequence: Synthetic peptide
  Seed: GIPDGPGGNA (CTG1B_HUMAN)
GIPDGPGGNL

SEQ ID NO: 30068 - protein, 8 aa, Artificial Sequence
  Description of Artificial Sequence: Synthetic peptide
  Seed: MPFATPME (CTG1B_HUMAN)
MAFATPMY

SEQ ID NO: 30069 - protein, 9 aa, Artificial Sequence
  Description of Artificial Sequence: Synthetic peptide
  Seed: TVSGNILTI (CTG1B_HUMAN)
TVSGNILTW

SEQ ID NO: 30070 - protein, 11 aa, Artificial Sequence
  Description of Artificial Sequence: Synthetic peptide
  Seed: YLAMPFATPME (CTG1B_HUMAN)
YYAMPFATPMV

SEQ ID NO: 30071 - protein, 9 aa, Artificial Sequence
  Description of Artificial Sequence: Synthetic peptide
  Seed: RLLEFYLAM (CTG1B_HUMAN)
RRLEFYLAF

SEQ ID NO: 30072 - protein, 9 aa, Artificial Sequence
  Description of Artificial Sequence: Synthetic peptide
  Seed: SGPGGGAPR (CTG1B_HUMAN)
SAPGGGAPI

SEQ ID NO: 30073 - protein, 10 aa, Artificial Sequence
  Description of Artificial Sequence: Synthetic peptide
  Seed: LLEFYLAMPF (CTG1B_HUMAN)
LGEFYLAMPF

SEQ ID NO: 30074 - protein, 10 aa, Artificial Sequence
  Description of Artificial Sequence: Synthetic peptide
  Seed: LQQLSLLMWI (CTG1B_HUMAN)
LDQLSLLMWV

SEQ ID NO: 30075 - protein, 11 aa, Artificial Sequence
  Description of Artificial Sequence: Synthetic peptide
  Seed: SLLMWITQCFL (CTG1B_HUMAN)
SYLMWITQCFV

SEQ ID NO: 30076 - protein, 10 aa, Artificial Sequence
  Description of Artificial Sequence: Synthetic peptide
  Seed: RGPESRLLEF (CTG1B_HUMAN)
RLPESRLLEL

SEQ ID NO: 30077 - protein, 9 aa, Artificial Sequence
  Description of Artificial Sequence: Synthetic peptide
  Seed: SISSCLQQL (CTG1B_HUMAN)
SQSSCLQQW

SEQ ID NO: 30078 - protein, 9 aa, Artificial Sequence
  Description of Artificial Sequence: Synthetic peptide
  Seed: FATPMEAEL (CTG1B_HUMAN)
FMTPMEAEF

SEQ ID NO: 30079 - protein, 10 aa, Artificial Sequence
  Description of Artificial Sequence: Synthetic peptide
  Seed: CLQQLSLLMW (CTG1B_HUMAN)
CSQQLSLLMW

SEQ ID NO: 30080 - protein, 9 aa, Artificial Sequence
  Description of Artificial Sequence: Synthetic peptide
  Seed: AADHRQLQL (CTG1B_HUMAN)
AWDHRQLQM

SEQ ID NO: 30081 - protein, 10 aa, Artificial Sequence
  Description of Artificial Sequence: Synthetic peptide
  Seed: FTVSGNILTI (CTG1B_HUMAN)
FGVSGNILTY

SEQ ID NO: 30082 - protein, 10 aa, Artificial Sequence
  Description of Artificial Sequence: Synthetic peptide
  Seed: FLPVFLAQPP (CTG1B_HUMAN)
FLPVFLAQPM

SEQ ID NO: 30083 - protein, 9 aa, Artificial Sequence
  Description of Artificial Sequence: Synthetic peptide
  Seed: LQLSISSCL (CTG1B_HUMAN)
LQLSISSCM

SEQ ID NO: 30084 - protein, 9 aa, Artificial Sequence
  Description of Artificial Sequence: Synthetic peptide
  Seed: LQLSISSCL (CTG1B_HUMAN)
LILSISSCL

SEQ ID NO: 30085 - protein, 9 aa, Artificial Sequence
  Description of Artificial Sequence: Synthetic peptide
  Seed: LAQPPSGQR (CTG1B_HUMAN)
LLQPPSGQR

SEQ ID NO: 30086 - protein, 10 aa, Artificial Sequence
  Description of Artificial Sequence: Synthetic peptide
  Seed: LLEFYLAMPF (CTG1B_HUMAN)
LVEFYLAMPW

SEQ ID NO: 30087 - protein, 9 aa, Artificial Sequence
  Description of Artificial Sequence: Synthetic peptide
  Seed: MPFATPMEA (CTG1B_HUMAN)
MHFATPMEA

SEQ ID NO: 30088 - protein, 9 aa, Artificial Sequence
  Description of Artificial Sequence: Synthetic peptide
  Seed: RLLEFYLAM (CTG1B_HUMAN)
RVLEFYLAK

SEQ ID NO: 30089 - protein, 10 aa, Artificial Sequence
  Description of Artificial Sequence: Synthetic peptide
  Seed: LSISSCLQQL (CTG1B_HUMAN)
LVISSCLQQW

SEQ ID NO: 30090 - protein, 10 aa, Artificial Sequence
  Description of Artificial Sequence: Synthetic peptide
  Seed: RGPESRLLEF (CTG1B_HUMAN)
RYPESRLLEY

SEQ ID NO: 30091 - protein, 9 aa, Artificial Sequence
  Description of Artificial Sequence: Synthetic peptide
  Seed: FATPMEAEL (CTG1B_HUMAN)
FMTPMEAET

SEQ ID NO: 30092 - protein, 9 aa, Artificial Sequence
  Description of Artificial Sequence: Synthetic peptide
  Seed: AQDAPPLPV (CTG1B_HUMAN)
AEDAPPLPM

SEQ ID NO: 30093 - protein, 11 aa, Artificial Sequence
  Description of Artificial Sequence: Synthetic peptide
  Seed: SSCLQQLSLLM (CTG1B_HUMAN)
SSCLQQLSLLW

SEQ ID NO: 30094 - protein, 10 aa, Artificial Sequence
  Description of Artificial Sequence: Synthetic peptide
  Seed: SRLLEFYLAM (CTG1B_HUMAN)
SPLLEFYLAM

SEQ ID NO: 30095 - protein, 10 aa, Artificial Sequence
  Description of Artificial Sequence: Synthetic peptide
  Seed: RLLEFYLAMP (CTG1B_HUMAN)
RILEFYLAML

SEQ ID NO: 30096 - protein, 10 aa, Artificial Sequence
  Description of Artificial Sequence: Synthetic peptide
  Seed: YLAMPFATPM (CTG1B_HUMAN)
YFAMPFATPA

SEQ ID NO: 30097 - protein, 10 aa, Artificial Sequence
  Description of Artificial Sequence: Synthetic peptide
  Seed: FLPVFLAQPP (CTG1B_HUMAN)
FWPVFLAQPA

SEQ ID NO: 30098 - protein, 9 aa, Artificial Sequence
  Description of Artificial Sequence: Synthetic peptide
  Seed: SLLMWITQC (CTG1B_HUMAN)
SLLMWITQT

SEQ ID NO: 30099 - protein, 10 aa, Artificial Sequence
  Description of Artificial Sequence: Synthetic peptide
  Seed: FYLAMPFATP (CTG1B_HUMAN)
FELAMPFATI

SEQ ID NO: 30100 - protein, 9 aa, Artificial Sequence
  Description of Artificial Sequence: Synthetic peptide
  Seed: MQAEGRGTG (CTG1B_HUMAN)
MSAEGRGTM

SEQ ID NO: 30101 - protein, 9 aa, Artificial Sequence
  Description of Artificial Sequence: Synthetic peptide
  Seed: APPLPVPGV (CTG1B_HUMAN)
AQPLPVPGI

SEQ ID NO: 30102 - protein, 9 aa, Artificial Sequence
  Description of Artificial Sequence: Synthetic peptide
  Seed: GARGPESRL (CTG1B_HUMAN)
GMRGPESRF

SEQ ID NO: 30103 - protein, 9 aa, Artificial Sequence
  Description of Artificial Sequence: Synthetic peptide
  Seed: RASGPGGGA (CTG1B_HUMAN)
RASGPGGGM

SEQ ID NO: 30104 - protein, 10 aa, Artificial Sequence
  Description of Artificial Sequence: Synthetic peptide
  Seed: FYLAMPFATP (CTG1B_HUMAN)
FGLAMPFATA

SEQ ID NO: 30105 - protein, 10 aa, Artificial Sequence
  Description of Artificial Sequence: Synthetic peptide
  Seed: APRGPHGGAA (CTG1B_HUMAN)
AVRGPHGGAM

SEQ ID NO: 30106 - protein, 9 aa, Artificial Sequence
  Description of Artificial Sequence: Synthetic peptide
  Seed: LQLSISSCL (CTG1B_HUMAN)
LVLSISSCF

SEQ ID NO: 30107 - protein, 9 aa, Artificial Sequence
  Description of Artificial Sequence: Synthetic peptide
  Seed: SISSCLQQL (CTG1B_HUMAN)
SQSSCLQQM

SEQ ID NO: 30108 - protein, 9 aa, Artificial Sequence
  Description of Artificial Sequence: Synthetic peptide
  Seed: IPDGPGGNA (CTG1B_HUMAN)
IVDGPGGNF

SEQ ID NO: 30109 - protein, 10 aa, Artificial Sequence
  Description of Artificial Sequence: Synthetic peptide
  Seed: LLEFYLAMPF (CTG1B_HUMAN)
LYEFYLAMPY

SEQ ID NO: 30110 - protein, 9 aa, Artificial Sequence
  Description of Artificial Sequence: Synthetic peptide
  Seed: MQAEGRGTG (CTG1B_HUMAN)
MHAEGRGTY

SEQ ID NO: 30111 - protein, 9 aa, Artificial Sequence
  Description of Artificial Sequence: Synthetic peptide
  Seed: MPFATPMEA (CTG1B_HUMAN)
MAFATPMEH

SEQ ID NO: 30112 - protein, 9 aa, Artificial Sequence
  Description of Artificial Sequence: Synthetic peptide
  Seed: MPFATPMEA (CTG1B_HUMAN)
MGFATPMEY

SEQ ID NO: 30113 - protein, 11 aa, Artificial Sequence
  Description of Artificial Sequence: Synthetic peptide
  Seed: YLAMPFATPME (CTG1B_HUMAN)
YAAMPFATPML

SEQ ID NO: 30114 - protein, 10 aa, Artificial Sequence
  Description of Artificial Sequence: Synthetic peptide
  Seed: GIPDGPGGNA (CTG1B_HUMAN)
GTPDGPGGNL

SEQ ID NO: 30115 - protein, 10 aa, Artificial Sequence
  Description of Artificial Sequence: Synthetic peptide
  Seed: MWITQCFLPV (CTG1B_HUMAN)
MYITQCFLPM

SEQ ID NO: 30116 - protein, 9 aa, Artificial Sequence
  Description of Artificial Sequence: Synthetic peptide
  Seed: RLLEFYLAM (CTG1B_HUMAN)
RCLEFYLAY

SEQ ID NO: 30117 - protein, 11 aa, Artificial Sequence
  Description of Artificial Sequence: Synthetic peptide
  Seed: FYLAMPFATPM (CTG1B_HUMAN)
FDLAMPFATPV

SEQ ID NO: 30118 - protein, 9 aa, Artificial Sequence
  Description of Artificial Sequence: Synthetic peptide
  Seed: LLKEFTVSG (CTG1B_HUMAN)
LLKEFTVSM

SEQ ID NO: 30119 - protein, 9 aa, Artificial Sequence
  Description of Artificial Sequence: Synthetic peptide
  Seed: LLMWITQCF (CTG1B_HUMAN)
LMMWITQCA

SEQ ID NO: 30120 - protein, 9 aa, Artificial Sequence
  Description of Artificial Sequence: Synthetic peptide
  Seed: AADHRQLQL (CTG1B_HUMAN)
AADHRQLQW

SEQ ID NO: 30121 - protein, 9 aa, Artificial Sequence
  Description of Artificial Sequence: Synthetic peptide
  Seed: APPLPVPGV (CTG1B_HUMAN)
ASPLPVPGF

SEQ ID NO: 30122 - protein, 10 aa, Artificial Sequence
  Description of Artificial Sequence: Synthetic peptide
  Seed: FLAQPPSGQR (CTG1B_HUMAN)
FVAQPPSGQL

SEQ ID NO: 30123 - protein, 10 aa, Artificial Sequence
  Description of Artificial Sequence: Synthetic peptide
  Seed: AMPFATPMEA (CTG1B_HUMAN)
ANPFATPMEY

SEQ ID NO: 30124 - protein, 9 aa, Artificial Sequence
  Description of Artificial Sequence: Synthetic peptide
  Seed: SISSCLQQL (CTG1B_HUMAN)
SLSSCLQQR

SEQ ID NO: 30125 - protein, 10 aa, Artificial Sequence
  Description of Artificial Sequence: Synthetic peptide
  Seed: FTVSGNILTI (CTG1B_HUMAN)
FSVSGNILTV

SEQ ID NO: 30126 - protein, 9 aa, Artificial Sequence
  Description of Artificial Sequence: Synthetic peptide
  Seed: AADHRQLQL (CTG1B_HUMAN)
AVDHRQLQY

SEQ ID NO: 30127 - protein, 10 aa, Artificial Sequence
  Description of Artificial Sequence: Synthetic peptide
  Seed: FLPVFLAQPP (CTG1B_HUMAN)
FRPVFLAQPA

SEQ ID NO: 30128 - protein, 9 aa, Artificial Sequence
  Description of Artificial Sequence: Synthetic peptide
  Seed: LAQPPSGQR (CTG1B_HUMAN)
LSQPPSGQF

SEQ ID NO: 30129 - protein, 9 aa, Artificial Sequence
  Description of Artificial Sequence: Synthetic peptide
  Seed: ASGPGGGAP (CTG1B_HUMAN)
AAGPGGGAV

SEQ ID NO: 30130 - protein, 8 aa, Artificial Sequence
  Description of Artificial Sequence: Synthetic peptide
  Seed: YLAMPFAT (CTG1B_HUMAN)
YMAMPFAI

SEQ ID NO: 30131 - protein, 9 aa, Artificial Sequence
  Description of Artificial Sequence: Synthetic peptide
  Seed: MPFATPMEA (CTG1B_HUMAN)
MQFATPMEA

SEQ ID NO: 30132 - protein, 9 aa, Artificial Sequence
  Description of Artificial Sequence: Synthetic peptide
  Seed: AQDAPPLPV (CTG1B_HUMAN)
AWDAPPLPF

SEQ ID NO: 30133 - protein, 9 aa, Artificial Sequence
  Description of Artificial Sequence: Synthetic peptide
  Seed: LEFYLAMPF (CTG1B_HUMAN)
LHFYLAMPM

SEQ ID NO: 30134 - protein, 11 aa, Artificial Sequence
  Description of Artificial Sequence: Synthetic peptide
  Seed: RLLEFYLAMPF (CTG1B_HUMAN)
RMLEFYLAMPF

SEQ ID NO: 30135 - protein, 10 aa, Artificial Sequence
  Description of Artificial Sequence: Synthetic peptide
  Seed: FYLAMPFATP (CTG1B_HUMAN)
FFLAMPFATL

SEQ ID NO: 30136 - protein, 9 aa, Artificial Sequence
  Description of Artificial Sequence: Synthetic peptide
  Seed: LPVFLAQPP (CTG1B_HUMAN)
LAVFLAQPF

SEQ ID NO: 30137 - protein, 11 aa, Artificial Sequence
  Description of Artificial Sequence: Synthetic peptide
  Seed: LAMPFATPMEA (CTG1B_HUMAN)
LLMPFATPMEA

SEQ ID NO: 30138 - protein, 9 aa, Artificial Sequence
  Description of Artificial Sequence: Synthetic peptide
  Seed: RLLEFYLAM (CTG1B_HUMAN)
RKLEFYLAV

SEQ ID NO: 30139 - protein, 10 aa, Artificial Sequence
  Description of Artificial Sequence: Synthetic peptide
  Seed: ITQCFLPVFL (CTG1B_HUMAN)
IMQCFLPVFM

SEQ ID NO: 30140 - protein, 9 aa, Artificial Sequence
  Description of Artificial Sequence: Synthetic peptide
  Seed: FYLAMPFAT (CTG1B_HUMAN)
FYLAMPFAI

SEQ ID NO: 30141 - protein, 10 aa, Artificial Sequence
  Description of Artificial Sequence: Synthetic peptide
  Seed: EFTVSGNILT (CTG1B_HUMAN)
EVTVSGNILV

SEQ ID NO: 30142 - protein, 10 aa, Artificial Sequence
  Description of Artificial Sequence: Synthetic peptide
  Seed: LAQPPSGQRR (CTG1B_HUMAN)
LMQPPSGQRR

SEQ ID NO: 30143 - protein, 10 aa, Artificial Sequence
  Description of Artificial Sequence: Synthetic peptide
  Seed: KEFTVSGNIL (CTG1B_HUMAN)
KHFTVSGNIL

SEQ ID NO: 30144 - protein, 10 aa, Artificial Sequence
  Description of Artificial Sequence: Synthetic peptide
  Seed: FTVSGNILTI (CTG1B_HUMAN)
FMVSGNILTL

SEQ ID NO: 30145 - protein, 10 aa, Artificial Sequence
  Description of Artificial Sequence: Synthetic peptide
  Seed: TAADHRQLQL (CTG1B_HUMAN)
TRADHRQLQF

SEQ ID NO: 30146 - protein, 11 aa, Artificial Sequence
  Description of Artificial Sequence: Synthetic peptide
  Seed: RASGPGGGAPR (CTG1B_HUMAN)
RISGPGGGAPL

SEQ ID NO: 30147 - protein, 9 aa, Artificial Sequence
  Description of Artificial Sequence: Synthetic peptide
  Seed: TPMEAELAR (CTG1B_HUMAN)
TAMEAELAR

SEQ ID NO: 30148 - protein, 9 aa, Artificial Sequence
  Description of Artificial Sequence: Synthetic peptide
  Seed: SSCLQQLSL (CTG1B_HUMAN)
SECLQQLSV

SEQ ID NO: 30149 - protein, 11 aa, Artificial Sequence
  Description of Artificial Sequence: Synthetic peptide
  Seed: FYLAMPFATPM (CTG1B_HUMAN)
FNLAMPFATPV

SEQ ID NO: 30150 - protein, 9 aa, Artificial Sequence
  Description of Artificial Sequence: Synthetic peptide
  Seed: FYLAMPFAT (CTG1B_HUMAN)
FFLAMPFAL

SEQ ID NO: 30151 - protein, 10 aa, Artificial Sequence
  Description of Artificial Sequence: Synthetic peptide
  Seed: RSLAQDAPPL (CTG1B_HUMAN)
RSLAQDAPPV

SEQ ID NO: 30152 - protein, 9 aa, Artificial Sequence
  Description of Artificial Sequence: Synthetic peptide
  Seed: DAPPLPVPG (CTG1B_HUMAN)
DAPPLPVPL

SEQ ID NO: 30153 - protein, 9 aa, Artificial Sequence
  Description of Artificial Sequence: Synthetic peptide
  Seed: LLMWITQCF (CTG1B_HUMAN)
LYMWITQCY

SEQ ID NO: 30154 - protein, 10 aa, Artificial Sequence
  Description of Artificial Sequence: Synthetic peptide
  Seed: SRLLEFYLAM (CTG1B_HUMAN)
SCLLEFYLAV

SEQ ID NO: 30155 - protein, 10 aa, Artificial Sequence
  Description of Artificial Sequence: Synthetic peptide
  Seed: LSISSCLQQL (CTG1B_HUMAN)
LVISSCLQQI

SEQ ID NO: 30156 - protein, 10 aa, Artificial Sequence
  Description of Artificial Sequence: Synthetic peptide
  Seed: LSISSCLQQL (CTG1B_HUMAN)
LSISSCLQQW

SEQ ID NO: 30157 - protein, 10 aa, Artificial Sequence
  Description of Artificial Sequence: Synthetic peptide
  Seed: FYLAMPFATP (CTG1B_HUMAN)
FRLAMPFATV

SEQ ID NO: 30158 - protein, 9 aa, Artificial Sequence
  Description of Artificial Sequence: Synthetic peptide
  Seed: LLMWITQCF (CTG1B_HUMAN)
LMMWITQCF

SEQ ID NO: 30159 - protein, 10 aa, Artificial Sequence
  Description of Artificial Sequence: Synthetic peptide
  Seed: SSCLQQLSLL (CTG1B_HUMAN)
SACLQQLSLW

SEQ ID NO: 30160 - protein, 9 aa, Artificial Sequence
  Description of Artificial Sequence: Synthetic peptide
  Seed: FTVSGNILT (CTG1B_HUMAN)
FTVSGNILM

SEQ ID NO: 30161 - protein, 9 aa, Artificial Sequence
  Description of Artificial Sequence: Synthetic peptide
  Seed: SRLLEFYLA (CTG1B_HUMAN)
SRLLEFYLM

SEQ ID NO: 30162 - protein, 9 aa, Artificial Sequence
  Description of Artificial Sequence: Synthetic peptide
  Seed: FTVSGNILT (CTG1B_HUMAN)
FLVSGNILI

SEQ ID NO: 30163 - protein, 10 aa, Artificial Sequence
  Description of Artificial Sequence: Synthetic peptide
  Seed: RASGPGGGAP (CTG1B_HUMAN)
RTSGPGGGAF

SEQ ID NO: 30164 - protein, 9 aa, Artificial Sequence
  Description of Artificial Sequence: Synthetic peptide
  Seed: LEFYLAMPF (CTG1B_HUMAN)
LNFYLAMPF

SEQ ID NO: 30165 - protein, 8 aa, Artificial Sequence
  Description of Artificial Sequence: Synthetic peptide
  Seed: FTVSGNIL (CTG1B_HUMAN)
FAVSGNIM

SEQ ID NO: 30166 - protein, 9 aa, Artificial Sequence
  Description of Artificial Sequence: Synthetic peptide
  Seed: FATPMEAEL (CTG1B_HUMAN)
FQTPMEAEW

SEQ ID NO: 30167 - protein, 9 aa, Artificial Sequence
  Description of Artificial Sequence: Synthetic peptide
  Seed: LAMPFATPM (CTG1B_HUMAN)
LVMPFATPK

SEQ ID NO: 30168 - protein, 9 aa, Artificial Sequence
  Description of Artificial Sequence: Synthetic peptide
  Seed: LAMPFATPM (CTG1B_HUMAN)
LQMPFATPV

SEQ ID NO: 30169 - protein, 9 aa, Artificial Sequence
  Description of Artificial Sequence: Synthetic peptide
  Seed: RLLEFYLAM (CTG1B_HUMAN)
RQLEFYLAG

SEQ ID NO: 30170 - protein, 9 aa, Artificial Sequence
  Description of Artificial Sequence: Synthetic peptide
  Seed: FATPMEAEL (CTG1B_HUMAN)
FATPMEAEY

SEQ ID NO: 30171 - protein, 9 aa, Artificial Sequence
  Description of Artificial Sequence: Synthetic peptide
  Seed: LEFYLAMPF (CTG1B_HUMAN)
LPFYLAMPM

SEQ ID NO: 30172 - protein, 11 aa, Artificial Sequence
  Description of Artificial Sequence: Synthetic peptide
  Seed: RLLEFYLAMPF (CTG1B_HUMAN)
RKLEFYLAMPL

SEQ ID NO: 30173 - protein, 9 aa, Artificial Sequence
  Description of Artificial Sequence: Synthetic peptide
  Seed: TVSGNILTI (CTG1B_HUMAN)
TNSGNILTL

SEQ ID NO: 30174 - protein, 9 aa, Artificial Sequence
  Description of Artificial Sequence: Synthetic peptide
  Seed: ITQCFLPVF (CTG1B_HUMAN)
IKQCFLPVY

SEQ ID NO: 30175 - protein, 10 aa, Artificial Sequence
  Description of Artificial Sequence: Synthetic peptide
  Seed: LLMWITQCFL (CTG1B_HUMAN)
LNMWITQCFV

SEQ ID NO: 30176 - protein, 9 aa, Artificial Sequence
  Description of Artificial Sequence: Synthetic peptide
  Seed: LPVPGVLLK (CTG1B_HUMAN)
LIVPGVLLM

SEQ ID NO: 30177 - protein, 11 aa, Artificial Sequence
  Description of Artificial Sequence: Synthetic peptide
  Seed: GAPRGPHGGAA (CTG1B_HUMAN)
GRPRGPHGGAV

SEQ ID NO: 30178 - protein, 9 aa, Artificial Sequence
  Description of Artificial Sequence: Synthetic peptide
  Seed: WITQCFLPV (CTG1B_HUMAN)
WQTQCFLPL

SEQ ID NO: 30179 - protein, 9 aa, Artificial Sequence
  Description of Artificial Sequence: Synthetic peptide
  Seed: MPFATPMEA (CTG1B_HUMAN)
MPFATPMES

SEQ ID NO: 30180 - protein, 9 aa, Artificial Sequence
  Description of Artificial Sequence: Synthetic peptide
  Seed: VSGNILTIR (CTG1B_HUMAN)
VTGNILTIK

SEQ ID NO: 30181 - protein, 11 aa, Artificial Sequence
  Description of Artificial Sequence: Synthetic peptide
  Seed: YLAMPFATPME (CTG1B_HUMAN)
YMAMPFATPMM

SEQ ID NO: 30182 - protein, 10 aa, Artificial Sequence
  Description of Artificial Sequence: Synthetic peptide
  Seed: SRLLEFYLAM (CTG1B_HUMAN)
SGLLEFYLAV

SEQ ID NO: 30183 - protein, 11 aa, Artificial Sequence
  Description of Artificial Sequence: Synthetic peptide
  Seed: RASGPGGGAPR (CTG1B_HUMAN)
RPSGPGGGAPC

SEQ ID NO: 30184 - protein, 10 aa, Artificial Sequence
  Description of Artificial Sequence: Synthetic peptide
  Seed: FLPVFLAQPP (CTG1B_HUMAN)
FPPVFLAQPV

SEQ ID NO: 30185 - protein, 10 aa, Artificial Sequence
  Description of Artificial Sequence: Synthetic peptide
  Seed: FTVSGNILTI (CTG1B_HUMAN)
FPVSGNILTV

SEQ ID NO: 30186 - protein, 9 aa, Artificial Sequence
  Description of Artificial Sequence: Synthetic peptide
  Seed: ASGPGGGAP (CTG1B_HUMAN)
AVGPGGGAL

SEQ ID NO: 30187 - protein, 10 aa, Artificial Sequence
  Description of Artificial Sequence: Synthetic peptide
  Seed: SRLLEFYLAM (CTG1B_HUMAN)
SHLLEFYLAL

SEQ ID NO: 30188 - protein, 10 aa, Artificial Sequence
  Description of Artificial Sequence: Synthetic peptide
  Seed: RLLEFYLAMP (CTG1B_HUMAN)
RELEFYLAMV

SEQ ID NO: 30189 - protein, 9 aa, Artificial Sequence
  Description of Artificial Sequence: Synthetic peptide
  Seed: FATPMEAEL (CTG1B_HUMAN)
FFTPMEAEM

SEQ ID NO: 30190 - protein, 10 aa, Artificial Sequence
  Description of Artificial Sequence: Synthetic peptide
  Seed: LLEFYLAMPF (CTG1B_HUMAN)
LSEFYLAMPF

SEQ ID NO: 30191 - protein, 9 aa, Artificial Sequence
  Description of Artificial Sequence: Synthetic peptide
  Seed: TVSGNILTI (CTG1B_HUMAN)
TASGNILTA

SEQ ID NO: 30192 - protein, 9 aa, Artificial Sequence
  Description of Artificial Sequence: Synthetic peptide
  Seed: FATPMEAEL (CTG1B_HUMAN)
FGTPMEAEM

SEQ ID NO: 30193 - protein, 9 aa, Artificial Sequence
  Description of Artificial Sequence: Synthetic peptide
  Seed: MQAEGRGTG (CTG1B_HUMAN)
MAAEGRGTM

SEQ ID NO: 30194 - protein, 10 aa, Artificial Sequence
  Description of Artificial Sequence: Synthetic peptide
  Seed: FYLAMPFATP (CTG1B_HUMAN)
FALAMPFATV

SEQ ID NO: 30195 - protein, 9 aa, Artificial Sequence
  Description of Artificial Sequence: Synthetic peptide
  Seed: LMWITQCFL (CTG1B_HUMAN)
LKWITQCFM

SEQ ID NO: 30196 - protein, 9 aa, Artificial Sequence
  Description of Artificial Sequence: Synthetic peptide
  Seed: SISSCLQQL (CTG1B_HUMAN)
SASSCLQQM

SEQ ID NO: 30197 - protein, 9 aa, Artificial Sequence
  Description of Artificial Sequence: Synthetic peptide
  Seed: SLAQDAPPL (CTG1B_HUMAN)
SSAQDAPPM

SEQ ID NO: 30198 - protein, 9 aa, Artificial Sequence
  Description of Artificial Sequence: Synthetic peptide
  Seed: ILTIRLTAA (CTG1B_HUMAN)
IMTIRLTAA

SEQ ID NO: 30199 - protein, 9 aa, Artificial Sequence
  Description of Artificial Sequence: Synthetic peptide
  Seed: SISSCLQQL (CTG1B_HUMAN)
SMSSCLQQY

SEQ ID NO: 30200 - protein, 9 aa, Artificial Sequence
  Description of Artificial Sequence: Synthetic peptide
  Seed: LLMWITQCF (CTG1B_HUMAN)
LQMWITQCM

SEQ ID NO: 30201 - protein, 11 aa, Artificial Sequence
  Description of Artificial Sequence: Synthetic peptide
  Seed: LLMWITQCFLP (CTG1B_HUMAN)
LMMWITQCFLL

SEQ ID NO: 30202 - protein, 9 aa, Artificial Sequence
  Description of Artificial Sequence: Synthetic peptide
  Seed: APPLPVPGV (CTG1B_HUMAN)
AAPLPVPGF

SEQ ID NO: 30203 - protein, 11 aa, Artificial Sequence
  Description of Artificial Sequence: Synthetic peptide
  Seed: FYLAMPFATPM (CTG1B_HUMAN)
FRLAMPFATPI

SEQ ID NO: 30204 - protein, 10 aa, Artificial Sequence
  Description of Artificial Sequence: Synthetic peptide
  Seed: FTVSGNILTI (CTG1B_HUMAN)
FVVSGNILTY

SEQ ID NO: 30205 - protein, 9 aa, Artificial Sequence
  Description of Artificial Sequence: Synthetic peptide
  Seed: MPFATPMEA (CTG1B_HUMAN)
MSFATPMEW

SEQ ID NO: 30206 - protein, 9 aa, Artificial Sequence
  Description of Artificial Sequence: Synthetic peptide
  Seed: QQLSLLMWI (CTG1B_HUMAN)
QLLSLLMWT

SEQ ID NO: 30207 - protein, 10 aa, Artificial Sequence
  Description of Artificial Sequence: Synthetic peptide
  Seed: FTVSGNILTI (CTG1B_HUMAN)
FIVSGNILTT

SEQ ID NO: 30208 - protein, 11 aa, Artificial Sequence
  Description of Artificial Sequence: Synthetic peptide
  Seed: SLLMWITQCFL (CTG1B_HUMAN)
SYLMWITQCFL

SEQ ID NO: 30209 - protein, 9 aa, Artificial Sequence
  Description of Artificial Sequence: Synthetic peptide
  Seed: IPDGPGGNA (CTG1B_HUMAN)
ISDGPGGNM

SEQ ID NO: 30210 - protein, 9 aa, Artificial Sequence
  Description of Artificial Sequence: Synthetic peptide
  Seed: LEFYLAMPF (CTG1B_HUMAN)
LCFYLAMPF

SEQ ID NO: 30211 - protein, 9 aa, Artificial Sequence
  Description of Artificial Sequence: Synthetic peptide
  Seed: MPFATPMEA (CTG1B_HUMAN)
MPFATPMEN

SEQ ID NO: 30212 - protein, 10 aa, Artificial Sequence
  Description of Artificial Sequence: Synthetic peptide
  Seed: FLAQPPSGQR (CTG1B_HUMAN)
FVAQPPSGQM

SEQ ID NO: 30213 - protein, 11 aa, Artificial Sequence
  Description of Artificial Sequence: Synthetic peptide
  Seed: AEGRGTGGSTG (CTG1B_HUMAN)
AEGRGTGGSTL

SEQ ID NO: 30214 - protein, 10 aa, Artificial Sequence
  Description of Artificial Sequence: Synthetic peptide
  Seed: LSISSCLQQL (CTG1B_HUMAN)
LCISSCLQQW

SEQ ID NO: 30215 - protein, 11 aa, Artificial Sequence
  Description of Artificial Sequence: Synthetic peptide
  Seed: FYLAMPFATPM (CTG1B_HUMAN)
FRLAMPFATPF

SEQ ID NO: 30216 - protein, 11 aa, Artificial Sequence
  Description of Artificial Sequence: Synthetic peptide
  Seed: RASGPGGGAPR (CTG1B_HUMAN)
RWSGPGGGAPY

SEQ ID NO: 30217 - protein, 10 aa, Artificial Sequence
  Description of Artificial Sequence: Synthetic peptide
  Seed: MEAELARRSL (CTG1B_HUMAN)
MPAELARRSI

SEQ ID NO: 30218 - protein, 9 aa, Artificial Sequence
  Description of Artificial Sequence: Synthetic peptide
  Seed: RLLEFYLAM (CTG1B_HUMAN)
RTLEFYLAM

SEQ ID NO: 30219 - protein, 9 aa, Artificial Sequence
  Description of Artificial Sequence: Synthetic peptide
  Seed: RQLQLSISS (CTG1B_HUMAN)
RMLQLSISH

SEQ ID NO: 30220 - protein, 10 aa, Artificial Sequence
  Description of Artificial Sequence: Synthetic peptide
  Seed: LLEFYLAMPF (CTG1B_HUMAN)
LYEFYLAMPF

SEQ ID NO: 30221 - protein, 9 aa, Artificial Sequence
  Description of Artificial Sequence: Synthetic peptide
  Seed: SSCLQQLSL (CTG1B_HUMAN)
STCLQQLSF

SEQ ID NO: 30222 - protein, 10 aa, Artificial Sequence
  Description of Artificial Sequence: Synthetic peptide
  Seed: MEAELARRSL (CTG1B_HUMAN)
MEAELARRSM

SEQ ID NO: 30223 - protein, 11 aa, Artificial Sequence
  Description of Artificial Sequence: Synthetic peptide
  Seed: RLLEFYLAMPF (CTG1B_HUMAN)
RRLEFYLAMPF

SEQ ID NO: 30224 - protein, 10 aa, Artificial Sequence
  Description of Artificial Sequence: Synthetic peptide
  Seed: TAADHRQLQL (CTG1B_HUMAN)
TSADHRQLQF

SEQ ID NO: 30225 - protein, 9 aa, Artificial Sequence
  Description of Artificial Sequence: Synthetic peptide
  Seed: LMWITQCFL (CTG1B_HUMAN)
LKWITQCFY

SEQ ID NO: 30226 - protein, 11 aa, Artificial Sequence
  Description of Artificial Sequence: Synthetic peptide
  Seed: RLLEFYLAMPF (CTG1B_HUMAN)
RMLEFYLAMPI

SEQ ID NO: 30227 - protein, 10 aa, Artificial Sequence
  Description of Artificial Sequence: Synthetic peptide
  Seed: FYLAMPFATP (CTG1B_HUMAN)
FALAMPFATL

SEQ ID NO: 30228 - protein, 11 aa, Artificial Sequence
  Description of Artificial Sequence: Synthetic peptide
  Seed: RLLEFYLAMPF (CTG1B_HUMAN)
RALEFYLAMPV

SEQ ID NO: 30229 - protein, 10 aa, Artificial Sequence
  Description of Artificial Sequence: Synthetic peptide
  Seed: YLAMPFATPM (CTG1B_HUMAN)
YMAMPFATPC

SEQ ID NO: 30230 - protein, 9 aa, Artificial Sequence
  Description of Artificial Sequence: Synthetic peptide
  Seed: LAMPFATPM (CTG1B_HUMAN)
LMMPFATPK

SEQ ID NO: 30231 - protein, 9 aa, Artificial Sequence
  Description of Artificial Sequence: Synthetic peptide
  Seed: IPDGPGGNA (CTG1B_HUMAN)
ILDGPGGNM

SEQ ID NO: 30232 - protein, 9 aa, Artificial Sequence
  Description of Artificial Sequence: Synthetic peptide
  Seed: SGPGGGAPR (CTG1B_HUMAN)
SFPGGGAPM

SEQ ID NO: 30233 - protein, 10 aa, Artificial Sequence
  Description of Artificial Sequence: Synthetic peptide
  Seed: APRGPHGGAA (CTG1B_HUMAN)
APRGPHGGAI

SEQ ID NO: 30234 - protein, 9 aa, Artificial Sequence
  Description of Artificial Sequence: Synthetic peptide
  Seed: MPFATPMEA (CTG1B_HUMAN)
MPFATPMEV

SEQ ID NO: 30235 - protein, 9 aa, Artificial Sequence
  Description of Artificial Sequence: Synthetic peptide
  Seed: SISSCLQQL (CTG1B_HUMAN)
SQSSCLQQF

SEQ ID NO: 30236 - protein, 9 aa, Artificial Sequence
  Description of Artificial Sequence: Synthetic peptide
  Seed: SSCLQQLSL (CTG1B_HUMAN)
STCLQQLSL

SEQ ID NO: 30237 - protein, 9 aa, Artificial Sequence
  Description of Artificial Sequence: Synthetic peptide
  Seed: GPRGAGAAR (CTG1B_HUMAN)
GVRGAGAAL

SEQ ID NO: 30238 - protein, 9 aa, Artificial Sequence
  Description of Artificial Sequence: Synthetic peptide
  Seed: RQLQLSISS (CTG1B_HUMAN)
RFLQLSISF

SEQ ID NO: 30239 - protein, 11 aa, Artificial Sequence
  Description of Artificial Sequence: Synthetic peptide
  Seed: FYLAMPFATPM (CTG1B_HUMAN)
FPLAMPFATPM

SEQ ID NO: 30240 - protein, 10 aa, Artificial Sequence
  Description of Artificial Sequence: Synthetic peptide
  Seed: FYLAMPFATP (CTG1B_HUMAN)
FKLAMPFATM

SEQ ID NO: 30241 - protein, 9 aa, Artificial Sequence
  Description of Artificial Sequence: Synthetic peptide
  Seed: FLPVFLAQP (CTG1B_HUMAN)
FMPVFLAQM

SEQ ID NO: 30242 - protein, 9 aa, Artificial Sequence
  Description of Artificial Sequence: Synthetic peptide
  Seed: AQDAPPLPV (CTG1B_HUMAN)
AADAPPLPM

SEQ ID NO: 30243 - protein, 9 aa, Artificial Sequence
  Description of Artificial Sequence: Synthetic peptide
  Seed: FTVSGNILT (CTG1B_HUMAN)
FIVSGNILV

SEQ ID NO: 30244 - protein, 9 aa, Artificial Sequence
  Description of Artificial Sequence: Synthetic peptide
  Seed: RLLEFYLAM (CTG1B_HUMAN)
RSLEFYLAF

SEQ ID NO: 30245 - protein, 10 aa, Artificial Sequence
  Description of Artificial Sequence: Synthetic peptide
  Seed: FLPVFLAQPP (CTG1B_HUMAN)
FAPVFLAQPV

SEQ ID NO: 30246 - protein, 9 aa, Artificial Sequence
  Description of Artificial Sequence: Synthetic peptide
  Seed: LLKEFTVSG (CTG1B_HUMAN)
LMKEFTVSV

SEQ ID NO: 30247 - protein, 10 aa, Artificial Sequence
  Description of Artificial Sequence: Synthetic peptide
  Seed: SRLLEFYLAM (CTG1B_HUMAN)
SLLLEFYLAY

SEQ ID NO: 30248 - protein, 11 aa, Artificial Sequence
  Description of Artificial Sequence: Synthetic peptide
  Seed: GDADGPGGPGI (CTG1B_HUMAN)
GEADGPGGPGV

SEQ ID NO: 30249 - protein, 11 aa, Artificial Sequence
  Description of Artificial Sequence: Synthetic peptide
  Seed: GPRGAGAARAS (CTG1B_HUMAN)
GPRGAGAARAM

SEQ ID NO: 30250 - protein, 11 aa, Artificial Sequence
  Description of Artificial Sequence: Synthetic peptide
  Seed: RASGPGGGAPR (CTG1B_HUMAN)
RLSGPGGGAPR

SEQ ID NO: 30251 - protein, 9 aa, Artificial Sequence
  Description of Artificial Sequence: Synthetic peptide
  Seed: SGPGGGAPR (CTG1B_HUMAN)
STPGGGAPF

SEQ ID NO: 30252 - protein, 10 aa, Artificial Sequence
  Description of Artificial Sequence: Synthetic peptide
  Seed: ISSCLQQLSL (CTG1B_HUMAN)
IWSCLQQLSW

SEQ ID NO: 30253 - protein, 10 aa, Artificial Sequence
  Description of Artificial Sequence: Synthetic peptide
  Seed: RGPHGGAASG (CTG1B_HUMAN)
RWPHGGAASF

SEQ ID NO: 30254 - protein, 9 aa, Artificial Sequence
  Description of Artificial Sequence: Synthetic peptide
  Seed: MQAEGRGTG (CTG1B_HUMAN)
MQAEGRGTL

SEQ ID NO: 30255 - protein, 9 aa, Artificial Sequence
  Description of Artificial Sequence: Synthetic peptide
  Seed: LMWITQCFL (CTG1B_HUMAN)
LVWITQCFV

SEQ ID NO: 30256 - protein, 9 aa, Artificial Sequence
  Description of Artificial Sequence: Synthetic peptide
  Seed: IPDGPGGNA (CTG1B_HUMAN)
IGDGPGGNM

SEQ ID NO: 30257 - protein, 9 aa, Artificial Sequence
  Description of Artificial Sequence: Synthetic peptide
  Seed: FATPMEAEL (CTG1B_HUMAN)
FATPMEAEI

SEQ ID NO: 30258 - protein, 9 aa, Artificial Sequence
  Description of Artificial Sequence: Synthetic peptide
  Seed: MQAEGRGTG (CTG1B_HUMAN)
MKAEGRGTY

SEQ ID NO: 30259 - protein, 8 aa, Artificial Sequence
  Description of Artificial Sequence: Synthetic peptide
  Seed: LPVPGVLL (CTG1B_HUMAN)
LSVPGVLL

SEQ ID NO: 30260 - protein, 10 aa, Artificial Sequence
  Description of Artificial Sequence: Synthetic peptide
  Seed: LQQLSLLMWI (CTG1B_HUMAN)
LVQLSLLMWV

SEQ ID NO: 30261 - protein, 9 aa, Artificial Sequence
  Description of Artificial Sequence: Synthetic peptide
  Seed: QQLSLLMWI (CTG1B_HUMAN)
QLLSLLMWV

SEQ ID NO: 30262 - protein, 9 aa, Artificial Sequence
  Description of Artificial Sequence: Synthetic peptide
  Seed: RLLEFYLAM (CTG1B_HUMAN)
RVLEFYLAI

SEQ ID NO: 30263 - protein, 10 aa, Artificial Sequence
  Description of Artificial Sequence: Synthetic peptide
  Seed: RGPHGGAASG (CTG1B_HUMAN)
REPHGGAASV

SEQ ID NO: 30264 - protein, 10 aa, Artificial Sequence
  Description of Artificial Sequence: Synthetic peptide
  Seed: SRLLEFYLAM (CTG1B_HUMAN)
SYLLEFYLAI

SEQ ID NO: 30265 - protein, 10 aa, Artificial Sequence
  Description of Artificial Sequence: Synthetic peptide
  Seed: QQLSLLMWIT (CTG1B_HUMAN)
QQLSLLMWIV

SEQ ID NO: 30266 - protein, 9 aa, Artificial Sequence
  Description of Artificial Sequence: Synthetic peptide
  Seed: ILTIRLTAA (CTG1B_HUMAN)
IITIRLTAL

SEQ ID NO: 30267 - protein, 10 aa, Artificial Sequence
  Description of Artificial Sequence: Synthetic peptide
  Seed: SLLMWITQCF (CTG1B_HUMAN)
SDLMWITQCY

SEQ ID NO: 30268 - protein, 10 aa, Artificial Sequence
  Description of Artificial Sequence: Synthetic peptide
  Seed: SLLMWITQCF (CTG1B_HUMAN)
SILMWITQCY

SEQ ID NO: 30269 - protein, 9 aa, Artificial Sequence
  Description of Artificial Sequence: Synthetic peptide
  Seed: LPVPGVLLK (CTG1B_HUMAN)
LPVPGVLLV

SEQ ID NO: 30270 - protein, 10 aa, Artificial Sequence
  Description of Artificial Sequence: Synthetic peptide
  Seed: AMPFATPMEA (CTG1B_HUMAN)
ALPFATPMEY

SEQ ID NO: 30271 - protein, 9 aa, Artificial Sequence
  Description of Artificial Sequence: Synthetic peptide
  Seed: LAQPPSGQR (CTG1B_HUMAN)
LIQPPSGQF

SEQ ID NO: 30272 - protein, 9 aa, Artificial Sequence
  Description of Artificial Sequence: Synthetic peptide
  Seed: LEFYLAMPF (CTG1B_HUMAN)
LLFYLAMPY

SEQ ID NO: 30273 - protein, 9 aa, Artificial Sequence
  Description of Artificial Sequence: Synthetic peptide
  Seed: FTVSGNILT (CTG1B_HUMAN)
FSVSGNILL

SEQ ID NO: 30274 - protein, 10 aa, Artificial Sequence
  Description of Artificial Sequence: Synthetic peptide
  Seed: GPHGGAASGL (CTG1B_HUMAN)
GPHGGAASGA

SEQ ID NO: 30275 - protein, 9 aa, Artificial Sequence
  Description of Artificial Sequence: Synthetic peptide
  Seed: SLAQDAPPL (CTG1B_HUMAN)
SMAQDAPPV

SEQ ID NO: 30276 - protein, 10 aa, Artificial Sequence
  Description of Artificial Sequence: Synthetic peptide
  Seed: MPFATPMEAE (CTG1B_HUMAN)
MVFATPMEAF

SEQ ID NO: 30277 - protein, 9 aa, Artificial Sequence
  Description of Artificial Sequence: Synthetic peptide
  Seed: AADHRQLQL (CTG1B_HUMAN)
ASDHRQLQL

SEQ ID NO: 30278 - protein, 10 aa, Artificial Sequence
  Description of Artificial Sequence: Synthetic peptide
  Seed: SLLMWITQCF (CTG1B_HUMAN)
SMLMWITQCF

SEQ ID NO: 30279 - protein, 9 aa, Artificial Sequence
  Description of Artificial Sequence: Synthetic peptide
  Seed: FYLAMPFAT (CTG1B_HUMAN)
FFLAMPFAM

SEQ ID NO: 30280 - protein, 10 aa, Artificial Sequence
  Description of Artificial Sequence: Synthetic peptide
  Seed: RLLEFYLAMP (CTG1B_HUMAN)
RILEFYLAMV

SEQ ID NO: 30281 - protein, 9 aa, Artificial Sequence
  Description of Artificial Sequence: Synthetic peptide
  Seed: AQPPSGQRR (CTG1B_HUMAN)
AAPPSGQRM

SEQ ID NO: 30282 - protein, 10 aa, Artificial Sequence
  Description of Artificial Sequence: Synthetic peptide
  Seed: APPLPVPGVL (CTG1B_HUMAN)
AMPLPVPGVM

SEQ ID NO: 30283 - protein, 9 aa, Artificial Sequence
  Description of Artificial Sequence: Synthetic peptide
  Seed: IPDGPGGNA (CTG1B_HUMAN)
IVDGPGGNM

SEQ ID NO: 30284 - protein, 10 aa, Artificial Sequence
  Description of Artificial Sequence: Synthetic peptide
  Seed: ITQCFLPVFL (CTG1B_HUMAN)
IVQCFLPVFV

SEQ ID NO: 30285 - protein, 9 aa, Artificial Sequence
  Description of Artificial Sequence: Synthetic peptide
  Seed: GEAGATGGR (CTG1B_HUMAN)
GTAGATGGR

SEQ ID NO: 30286 - protein, 11 aa, Artificial Sequence
  Description of Artificial Sequence: Synthetic peptide
  Seed: RASGPGGGAPR (CTG1B_HUMAN)
RFSGPGGGAPY

SEQ ID NO: 30287 - protein, 10 aa, Artificial Sequence
  Description of Artificial Sequence: Synthetic peptide
  Seed: YLAMPFATPM (CTG1B_HUMAN)
YVAMPFATPF

SEQ ID NO: 30288 - protein, 10 aa, Artificial Sequence
  Description of Artificial Sequence: Synthetic peptide
  Seed: LEFYLAMPFA (CTG1B_HUMAN)
LQFYLAMPFV

SEQ ID NO: 30289 - protein, 10 aa, Artificial Sequence
  Description of Artificial Sequence: Synthetic peptide
  Seed: MEAELARRSL (CTG1B_HUMAN)
MEAELARRSV

SEQ ID NO: 30290 - protein, 10 aa, Artificial Sequence
  Description of Artificial Sequence: Synthetic peptide
  Seed: LSISSCLQQL (CTG1B_HUMAN)
LMISSCLQQV

SEQ ID NO: 30291 - protein, 10 aa, Artificial Sequence
  Description of Artificial Sequence: Synthetic peptide
  Seed: RGPHGGAASG (CTG1B_HUMAN)
RPPHGGAASL

SEQ ID NO: 30292 - protein, 10 aa, Artificial Sequence
  Description of Artificial Sequence: Synthetic peptide
  Seed: MWITQCFLPV (CTG1B_HUMAN)
MWITQCFLPF

SEQ ID NO: 30293 - protein, 10 aa, Artificial Sequence
  Description of Artificial Sequence: Synthetic peptide
  Seed: YLAMPFATPM (CTG1B_HUMAN)
YSAMPFATPV

SEQ ID NO: 30294 - protein, 9 aa, Artificial Sequence
  Description of Artificial Sequence: Synthetic peptide
  Seed: TVSGNILTI (CTG1B_HUMAN)
TMSGNILTT

SEQ ID NO: 30295 - protein, 10 aa, Artificial Sequence
  Description of Artificial Sequence: Synthetic peptide
  Seed: LLMWITQCFL (CTG1B_HUMAN)
LLMWITQCFT

SEQ ID NO: 30296 - protein, 10 aa, Artificial Sequence
  Description of Artificial Sequence: Synthetic peptide
  Seed: MWITQCFLPV (CTG1B_HUMAN)
MLITQCFLPA

SEQ ID NO: 30297 - protein, 9 aa, Artificial Sequence
  Description of Artificial Sequence: Synthetic peptide
  Seed: ADGPGGPGI (CTG1B_HUMAN)
AEGPGGPGP

SEQ ID NO: 30298 - protein, 9 aa, Artificial Sequence
  Description of Artificial Sequence: Synthetic peptide
  Seed: TPMEAELAR (CTG1B_HUMAN)
TTMEAELAF

SEQ ID NO: 30299 - protein, 10 aa, Artificial Sequence
  Description of Artificial Sequence: Synthetic peptide
  Seed: SRLLEFYLAM (CTG1B_HUMAN)
SRLLEFYLAA

SEQ ID NO: 30300 - protein, 9 aa, Artificial Sequence
  Description of Artificial Sequence: Synthetic peptide
  Seed: LAMPFATPM (CTG1B_HUMAN)
LRMPFATPI

SEQ ID NO: 30301 - protein, 9 aa, Artificial Sequence
  Description of Artificial Sequence: Synthetic peptide
  Seed: MPFATPMEA (CTG1B_HUMAN)
MLFATPMEI

SEQ ID NO: 30302 - protein, 10 aa, Artificial Sequence
  Description of Artificial Sequence: Synthetic peptide
  Seed: FTVSGNILTI (CTG1B_HUMAN)
FQVSGNILTT

SEQ ID NO: 30303 - protein, 11 aa, Artificial Sequence
  Description of Artificial Sequence: Synthetic peptide
  Seed: RASGPGGGAPR (CTG1B_HUMAN)
RQSGPGGGAPW

SEQ ID NO: 30304 - protein, 9 aa, Artificial Sequence
  Description of Artificial Sequence: Synthetic peptide
  Seed: QDAPPLPVP (CTG1B_HUMAN)
QEAPPLPVL

SEQ ID NO: 30305 - protein, 9 aa, Artificial Sequence
  Description of Artificial Sequence: Synthetic peptide
  Seed: TPMEAELAR (CTG1B_HUMAN)
TAMEAELAM

SEQ ID NO: 30306 - protein, 10 aa, Artificial Sequence
  Description of Artificial Sequence: Synthetic peptide
  Seed: RGPESRLLEF (CTG1B_HUMAN)
RQPESRLLEY

SEQ ID NO: 30307 - protein, 9 aa, Artificial Sequence
  Description of Artificial Sequence: Synthetic peptide
  Seed: MPFATPMEA (CTG1B_HUMAN)
MHFATPMEV

SEQ ID NO: 30308 - protein, 11 aa, Artificial Sequence
  Description of Artificial Sequence: Synthetic peptide
  Seed: SLLMWITQCFL (CTG1B_HUMAN)
SFLMWITQCFV

SEQ ID NO: 30309 - protein, 9 aa, Artificial Sequence
  Description of Artificial Sequence: Synthetic peptide
  Seed: APRGPHGGA (CTG1B_HUMAN)
APRGPHGGT

SEQ ID NO: 30310 - protein, 9 aa, Artificial Sequence
  Description of Artificial Sequence: Synthetic peptide
  Seed: MPFATPMEA (CTG1B_HUMAN)
MMFATPMEL

SEQ ID NO: 30311 - protein, 9 aa, Artificial Sequence
  Description of Artificial Sequence: Synthetic peptide
  Seed: LAQPPSGQR (CTG1B_HUMAN)
LAQPPSGQL

SEQ ID NO: 30312 - protein, 9 aa, Artificial Sequence
  Description of Artificial Sequence: Synthetic peptide
  Seed: RLLEFYLAM (CTG1B_HUMAN)
RMLEFYLAL

SEQ ID NO: 30313 - protein, 10 aa, Artificial Sequence
  Description of Artificial Sequence: Synthetic peptide
  Seed: MWITQCFLPV (CTG1B_HUMAN)
MLITQCFLPL

SEQ ID NO: 30314 - protein, 9 aa, Artificial Sequence
  Description of Artificial Sequence: Synthetic peptide
  Seed: LEFYLAMPF (CTG1B_HUMAN)
LPFYLAMPC

SEQ ID NO: 30315 - protein, 11 aa, Artificial Sequence
  Description of Artificial Sequence: Synthetic peptide
  Seed: SLLMWITQCFL (CTG1B_HUMAN)
SALMWITQCFV

SEQ ID NO: 30316 - protein, 10 aa, Artificial Sequence
  Description of Artificial Sequence: Synthetic peptide
  Seed: SRLLEFYLAM (CTG1B_HUMAN)
SRLLEFYLAY

SEQ ID NO: 30317 - protein, 9 aa, Artificial Sequence
  Description of Artificial Sequence: Synthetic peptide
  Seed: IPDGPGGNA (CTG1B_HUMAN)
ITDGPGGNI

SEQ ID NO: 30318 - protein, 10 aa, Artificial Sequence
  Description of Artificial Sequence: Synthetic peptide
  Seed: FLPVFLAQPP (CTG1B_HUMAN)
FGPVFLAQPV

SEQ ID NO: 30319 - protein, 9 aa, Artificial Sequence
  Description of Artificial Sequence: Synthetic peptide
  Seed: FATPMEAEL (CTG1B_HUMAN)
FMTPMEAEV

SEQ ID NO: 30320 - protein, 10 aa, Artificial Sequence
  Description of Artificial Sequence: Synthetic peptide
  Seed: KEFTVSGNIL (CTG1B_HUMAN)
KKFTVSGNIM

SEQ ID NO: 30321 - protein, 10 aa, Artificial Sequence
  Description of Artificial Sequence: Synthetic peptide
  Seed: MEAELARRSL (CTG1B_HUMAN)
MAAELARRSF

SEQ ID NO: 30322 - protein, 11 aa, Artificial Sequence
  Description of Artificial Sequence: Synthetic peptide
  Seed: YLAMPFATPME (CTG1B_HUMAN)
YMAMPFATPMA

SEQ ID NO: 30323 - protein, 10 aa, Artificial Sequence
  Description of Artificial Sequence: Synthetic peptide
  Seed: TVSGNILTIR (CTG1B_HUMAN)
TASGNILTIR

SEQ ID NO: 30324 - protein, 9 aa, Artificial Sequence
  Description of Artificial Sequence: Synthetic peptide
  Seed: TVSGNILTI (CTG1B_HUMAN)
TRSGNILTI

SEQ ID NO: 30325 - protein, 10 aa, Artificial Sequence
  Description of Artificial Sequence: Synthetic peptide
  Seed: MWITQCFLPV (CTG1B_HUMAN)
MIITQCFLPA

SEQ ID NO: 30326 - protein, 9 aa, Artificial Sequence
  Description of Artificial Sequence: Synthetic peptide
  Seed: LPVPGVLLK (CTG1B_HUMAN)
LIVPGVLLR

SEQ ID NO: 30327 - protein, 11 aa, Artificial Sequence
  Description of Artificial Sequence: Synthetic peptide
  Seed: RLLEFYLAMPF (CTG1B_HUMAN)
RWLEFYLAMPI

SEQ ID NO: 30328 - protein, 10 aa, Artificial Sequence
  Description of Artificial Sequence: Synthetic peptide
  Seed: YLAMPFATPM (CTG1B_HUMAN)
YVAMPFATPY

SEQ ID NO: 30329 - protein, 10 aa, Artificial Sequence
  Description of Artificial Sequence: Synthetic peptide
  Seed: TPMEAELARR (CTG1B_HUMAN)
TFMEAELARR

SEQ ID NO: 30330 - protein, 10 aa, Artificial Sequence
  Description of Artificial Sequence: Synthetic peptide
  Seed: ASGPGGGAPR (CTG1B_HUMAN)
AVGPGGGAPF

SEQ ID NO: 30331 - protein, 9 aa, Artificial Sequence
  Description of Artificial Sequence: Synthetic peptide
  Seed: SLLMWITQC (CTG1B_HUMAN)
SVLMWITQV

SEQ ID NO: 30332 - protein, 9 aa, Artificial Sequence
  Description of Artificial Sequence: Synthetic peptide
  Seed: LEFYLAMPF (CTG1B_HUMAN)
LHFYLAMPF

SEQ ID NO: 30333 - protein, 9 aa, Artificial Sequence
  Description of Artificial Sequence: Synthetic peptide
  Seed: MQAEGRGTG (CTG1B_HUMAN)
MLAEGRGTM

SEQ ID NO: 30334 - protein, 10 aa, Artificial Sequence
  Description of Artificial Sequence: Synthetic peptide
  Seed: MPFATPMEAE (CTG1B_HUMAN)
MPFATPMEAG

SEQ ID NO: 30335 - protein, 10 aa, Artificial Sequence
  Description of Artificial Sequence: Synthetic peptide
  Seed: FYLAMPFATP (CTG1B_HUMAN)
FFLAMPFATM

SEQ ID NO: 30336 - protein, 9 aa, Artificial Sequence
  Description of Artificial Sequence: Synthetic peptide
  Seed: LLMWITQCF (CTG1B_HUMAN)
LYMWITQCM

SEQ ID NO: 30337 - protein, 9 aa, Artificial Sequence
  Description of Artificial Sequence: Synthetic peptide
  Seed: LLKEFTVSG (CTG1B_HUMAN)
LLKEFTVSL

SEQ ID NO: 30338 - protein, 10 aa, Artificial Sequence
  Description of Artificial Sequence: Synthetic peptide
  Seed: DAPPLPVPGV (CTG1B_HUMAN)
DVPPLPVPGV

SEQ ID NO: 30339 - protein, 9 aa, Artificial Sequence
  Description of Artificial Sequence: Synthetic peptide
  Seed: TVSGNILTI (CTG1B_HUMAN)
TLSGNILTM

SEQ ID NO: 30340 - protein, 9 aa, Artificial Sequence
  Description of Artificial Sequence: Synthetic peptide
  Seed: LEFYLAMPF (CTG1B_HUMAN)
LMFYLAMPY

SEQ ID NO: 30341 - protein, 9 aa, Artificial Sequence
  Description of Artificial Sequence: Synthetic peptide
  Seed: LAMPFATPM (CTG1B_HUMAN)
LTMPFATPL

SEQ ID NO: 30342 - protein, 8 aa, Artificial Sequence
  Description of Artificial Sequence: Synthetic peptide
  Seed: YLAMPFAT (CTG1B_HUMAN)
YLAMPFAI

SEQ ID NO: 30343 - protein, 10 aa, Artificial Sequence
  Description of Artificial Sequence: Synthetic peptide
  Seed: KEFTVSGNIL (CTG1B_HUMAN)
KQFTVSGNIM

SEQ ID NO: 30344 - protein, 10 aa, Artificial Sequence
  Description of Artificial Sequence: Synthetic peptide
  Seed: ASGPGGGAPR (CTG1B_HUMAN)
AAGPGGGAPL

SEQ ID NO: 30345 - protein, 9 aa, Artificial Sequence
  Description of Artificial Sequence: Synthetic peptide
  Seed: FATPMEAEL (CTG1B_HUMAN)
FPTPMEAEI

SEQ ID NO: 30346 - protein, 9 aa, Artificial Sequence
  Description of Artificial Sequence: Synthetic peptide
  Seed: RQLQLSISS (CTG1B_HUMAN)
RQLQLSISY

SEQ ID NO: 30347 - protein, 10 aa, Artificial Sequence
  Description of Artificial Sequence: Synthetic peptide
  Seed: GIPDGPGGNA (CTG1B_HUMAN)
GMPDGPGGNL

SEQ ID NO: 30348 - protein, 9 aa, Artificial Sequence
  Description of Artificial Sequence: Synthetic peptide
  Seed: LQLSISSCL (CTG1B_HUMAN)
LELSISSCL

SEQ ID NO: 30349 - protein, 9 aa, Artificial Sequence
  Description of Artificial Sequence: Synthetic peptide
  Seed: RLLEFYLAM (CTG1B_HUMAN)
RALEFYLAR

SEQ ID NO: 30350 - protein, 10 aa, Artificial Sequence
  Description of Artificial Sequence: Synthetic peptide
  Seed: RASGPGGGAP (CTG1B_HUMAN)
RSSGPGGGAY

SEQ ID NO: 30351 - protein, 9 aa, Artificial Sequence
  Description of Artificial Sequence: Synthetic peptide
  Seed: MPFATPMEA (CTG1B_HUMAN)
MAFATPMEI

SEQ ID NO: 30352 - protein, 9 aa, Artificial Sequence
  Description of Artificial Sequence: Synthetic peptide
  Seed: LEFYLAMPF (CTG1B_HUMAN)
LGFYLAMPF

SEQ ID NO: 30353 - protein, 10 aa, Artificial Sequence
  Description of Artificial Sequence: Synthetic peptide
  Seed: SRLLEFYLAM (CTG1B_HUMAN)
SILLEFYLAL

SEQ ID NO: 30354 - protein, 10 aa, Artificial Sequence
  Description of Artificial Sequence: Synthetic peptide
  Seed: YLAMPFATPM (CTG1B_HUMAN)
YHAMPFATPM

SEQ ID NO: 30355 - protein, 10 aa, Artificial Sequence
  Description of Artificial Sequence: Synthetic peptide
  Seed: YLAMPFATPM (CTG1B_HUMAN)
YIAMPFATPY

SEQ ID NO: 30356 - protein, 10 aa, Artificial Sequence
  Description of Artificial Sequence: Synthetic peptide
  Seed: FTVSGNILTI (CTG1B_HUMAN)
FTVSGNILTT

SEQ ID NO: 30357 - protein, 10 aa, Artificial Sequence
  Description of Artificial Sequence: Synthetic peptide
  Seed: SRLLEFYLAM (CTG1B_HUMAN)
SDLLEFYLAV

SEQ ID NO: 30358 - protein, 9 aa, Artificial Sequence
  Description of Artificial Sequence: Synthetic peptide
  Seed: AQDAPPLPV (CTG1B_HUMAN)
AFDAPPLPM

SEQ ID NO: 30359 - protein, 9 aa, Artificial Sequence
  Description of Artificial Sequence: Synthetic peptide
  Seed: LLMWITQCF (CTG1B_HUMAN)
LQMWITQCW

SEQ ID NO: 30360 - protein, 9 aa, Artificial Sequence
  Description of Artificial Sequence: Synthetic peptide
  Seed: LLMWITQCF (CTG1B_HUMAN)
LTMWITQCV

SEQ ID NO: 30361 - protein, 9 aa, Artificial Sequence
  Description of Artificial Sequence: Synthetic peptide
  Seed: LAMPFATPM (CTG1B_HUMAN)
LYMPFATPL

SEQ ID NO: 30362 - protein, 9 aa, Artificial Sequence
  Description of Artificial Sequence: Synthetic peptide
  Seed: LPVFLAQPP (CTG1B_HUMAN)
LPVFLAQPI

SEQ ID NO: 30363 - protein, 8 aa, Artificial Sequence
  Description of Artificial Sequence: Synthetic peptide
  Seed: GPRGAGAA (CTG1B_HUMAN)
GPRGAGAI

SEQ ID NO: 30364 - protein, 9 aa, Artificial Sequence
  Description of Artificial Sequence: Synthetic peptide
  Seed: TVSGNILTI (CTG1B_HUMAN)
TASGNILTF

SEQ ID NO: 30365 - protein, 9 aa, Artificial Sequence
  Description of Artificial Sequence: Synthetic peptide
  Seed: LAMPFATPM (CTG1B_HUMAN)
LIMPFATPI

SEQ ID NO: 30366 - protein, 10 aa, Artificial Sequence
  Description of Artificial Sequence: Synthetic peptide
  Seed: ASGPGGGAPR (CTG1B_HUMAN)
AMGPGGGAPY

SEQ ID NO: 30367 - protein, 9 aa, Artificial Sequence
  Description of Artificial Sequence: Synthetic peptide
  Seed: GARGPESRL (CTG1B_HUMAN)
GPRGPESRM

SEQ ID NO: 30368 - protein, 10 aa, Artificial Sequence
  Description of Artificial Sequence: Synthetic peptide
  Seed: RSLAQDAPPL (CTG1B_HUMAN)
RPLAQDAPPV

SEQ ID NO: 30369 - protein, 11 aa, Artificial Sequence
  Description of Artificial Sequence: Synthetic peptide
  Seed: FYLAMPFATPM (CTG1B_HUMAN)
FYLAMPFATPL

SEQ ID NO: 30370 - protein, 10 aa, Artificial Sequence
  Description of Artificial Sequence: Synthetic peptide
  Seed: FLPVFLAQPP (CTG1B_HUMAN)
FRPVFLAQPT

SEQ ID NO: 30371 - protein, 9 aa, Artificial Sequence
  Description of Artificial Sequence: Synthetic peptide
  Seed: SLAQDAPPL (CTG1B_HUMAN)
SMAQDAPPI

SEQ ID NO: 30372 - protein, 10 aa, Artificial Sequence
  Description of Artificial Sequence: Synthetic peptide
  Seed: RGPRGAGAAR (CTG1B_HUMAN)
RIPRGAGAAR

SEQ ID NO: 30373 - protein, 10 aa, Artificial Sequence
  Description of Artificial Sequence: Synthetic peptide
  Seed: RLLEFYLAMP (CTG1B_HUMAN)
RWLEFYLAMV

SEQ ID NO: 30374 - protein, 10 aa, Artificial Sequence
  Description of Artificial Sequence: Synthetic peptide
  Seed: YLAMPFATPM (CTG1B_HUMAN)
YMAMPFATPW

SEQ ID NO: 30375 - protein, 10 aa, Artificial Sequence
  Description of Artificial Sequence: Synthetic peptide
  Seed: ADHRQLQLSI (CTG1B_HUMAN)
AEHRQLQLSL

SEQ ID NO: 30376 - protein, 9 aa, Artificial Sequence
  Description of Artificial Sequence: Synthetic peptide
  Seed: LPVPGVLLK (CTG1B_HUMAN)
LAVPGVLLM

SEQ ID NO: 30377 - protein, 9 aa, Artificial Sequence
  Description of Artificial Sequence: Synthetic peptide
  Seed: ITQCFLPVF (CTG1B_HUMAN)
IRQCFLPVY

SEQ ID NO: 30378 - protein, 9 aa, Artificial Sequence
  Description of Artificial Sequence: Synthetic peptide
  Seed: RLLEFYLAM (CTG1B_HUMAN)
RNLEFYLAM

SEQ ID NO: 30379 - protein, 9 aa, Artificial Sequence
  Description of Artificial Sequence: Synthetic peptide
  Seed: ITQCFLPVF (CTG1B_HUMAN)
IAQCFLPVW

SEQ ID NO: 30380 - protein, 10 aa, Artificial Sequence
  Description of Artificial Sequence: Synthetic peptide
  Seed: LAQDAPPLPV (CTG1B_HUMAN)
LMQDAPPLPL

SEQ ID NO: 30381 - protein, 9 aa, Artificial Sequence
  Description of Artificial Sequence: Synthetic peptide
  Seed: SGPGGGAPR (CTG1B_HUMAN)
SSPGGGAPM

SEQ ID NO: 30382 - protein, 8 aa, Artificial Sequence
  Description of Artificial Sequence: Synthetic peptide
  Seed: VSGNILTI (CTG1B_HUMAN)
VAGNILTL

SEQ ID NO: 30383 - protein, 10 aa, Artificial Sequence
  Description of Artificial Sequence: Synthetic peptide
  Seed: FLPVFLAQPP (CTG1B_HUMAN)
FIPVFLAQPI

SEQ ID NO: 30384 - protein, 10 aa, Artificial Sequence
  Description of Artificial Sequence: Synthetic peptide
  Seed: GAPRGPHGGA (CTG1B_HUMAN)
GFPRGPHGGL

SEQ ID NO: 30385 - protein, 9 aa, Artificial Sequence
  Description of Artificial Sequence: Synthetic peptide
  Seed: LLMWITQCF (CTG1B_HUMAN)
LLMWITQCI

SEQ ID NO: 30386 - protein, 10 aa, Artificial Sequence
  Description of Artificial Sequence: Synthetic peptide
  Seed: LEFYLAMPFA (CTG1B_HUMAN)
LSFYLAMPFF

SEQ ID NO: 30387 - protein, 9 aa, Artificial Sequence
  Description of Artificial Sequence: Synthetic peptide
  Seed: LLMWITQCF (CTG1B_HUMAN)
LHMWITQCF

SEQ ID NO: 30388 - protein, 9 aa, Artificial Sequence
  Description of Artificial Sequence: Synthetic peptide
  Seed: LQLSISSCL (CTG1B_HUMAN)
LMLSISSCY

SEQ ID NO: 30389 - protein, 10 aa, Artificial Sequence
  Description of Artificial Sequence: Synthetic peptide
  Seed: RGPESRLLEF (CTG1B_HUMAN)
RHPESRLLEM

SEQ ID NO: 30390 - protein, 11 aa, Artificial Sequence
  Description of Artificial Sequence: Synthetic peptide
  Seed: RLLEFYLAMPF (CTG1B_HUMAN)
RILEFYLAMPM

SEQ ID NO: 30391 - protein, 9 aa, Artificial Sequence
  Description of Artificial Sequence: Synthetic peptide
  Seed: RQLQLSISS (CTG1B_HUMAN)
RQLQLSISW

SEQ ID NO: 30392 - protein, 10 aa, Artificial Sequence
  Description of Artificial Sequence: Synthetic peptide
  Seed: RSLAQDAPPL (CTG1B_HUMAN)
RYLAQDAPPV

SEQ ID NO: 30393 - protein, 11 aa, Artificial Sequence
  Description of Artificial Sequence: Synthetic peptide
  Seed: FYLAMPFATPM (CTG1B_HUMAN)
FFLAMPFATPM

SEQ ID NO: 30394 - protein, 9 aa, Artificial Sequence
  Description of Artificial Sequence: Synthetic peptide
  Seed: ASGPGGGAP (CTG1B_HUMAN)
AVGPGGGAM

SEQ ID NO: 30395 - protein, 11 aa, Artificial Sequence
  Description of Artificial Sequence: Synthetic peptide
  Seed: GRGPRGAGAAR (CTG1B_HUMAN)
GRGPRGAGAAF

SEQ ID NO: 30396 - protein, 10 aa, Artificial Sequence
  Description of Artificial Sequence: Synthetic peptide
  Seed: SRLLEFYLAM (CTG1B_HUMAN)
SYLLEFYLAY

SEQ ID NO: 30397 - protein, 9 aa, Artificial Sequence
  Description of Artificial Sequence: Synthetic peptide
  Seed: RLLEFYLAM (CTG1B_HUMAN)
RSLEFYLAK

SEQ ID NO: 30398 - protein, 9 aa, Artificial Sequence
  Description of Artificial Sequence: Synthetic peptide
  Seed: CLQQLSLLM (CTG1B_HUMAN)
CKQQLSLLF

SEQ ID NO: 30399 - protein, 9 aa, Artificial Sequence
  Description of Artificial Sequence: Synthetic peptide
  Seed: FATPMEAEL (CTG1B_HUMAN)
FTTPMEAEM

SEQ ID NO: 30400 - protein, 11 aa, Artificial Sequence
  Description of Artificial Sequence: Synthetic peptide
  Seed: RLLEFYLAMPF (CTG1B_HUMAN)
RILEFYLAMPL

SEQ ID NO: 30401 - protein, 10 aa, Artificial Sequence
  Description of Artificial Sequence: Synthetic peptide
  Seed: FYLAMPFATP (CTG1B_HUMAN)
FHLAMPFATL

SEQ ID NO: 30402 - protein, 10 aa, Artificial Sequence
  Description of Artificial Sequence: Synthetic peptide
  Seed: LLEFYLAMPF (CTG1B_HUMAN)
LHEFYLAMPW

SEQ ID NO: 30403 - protein, 10 aa, Artificial Sequence
  Description of Artificial Sequence: Synthetic peptide
  Seed: RGPHGGAASG (CTG1B_HUMAN)
RHPHGGAASF

SEQ ID NO: 30404 - protein, 10 aa, Artificial Sequence
  Description of Artificial Sequence: Synthetic peptide
  Seed: ASGPGGGAPR (CTG1B_HUMAN)
AQGPGGGAPY

SEQ ID NO: 30405 - protein, 9 aa, Artificial Sequence
  Description of Artificial Sequence: Synthetic peptide
  Seed: TPMEAELAR (CTG1B_HUMAN)
TVMEAELAF

SEQ ID NO: 30406 - protein, 9 aa, Artificial Sequence
  Description of Artificial Sequence: Synthetic peptide
  Seed: LAMPFATPM (CTG1B_HUMAN)
LQMPFATPM

SEQ ID NO: 30407 - protein, 11 aa, Artificial Sequence
  Description of Artificial Sequence: Synthetic peptide
  Seed: GGRGPRGAGAA (CTG1B_HUMAN)
GPRGPRGAGAA

SEQ ID NO: 30408 - protein, 9 aa, Artificial Sequence
  Description of Artificial Sequence: Synthetic peptide
  Seed: AQDAPPLPV (CTG1B_HUMAN)
ATDAPPLPL

SEQ ID NO: 30409 - protein, 10 aa, Artificial Sequence
  Description of Artificial Sequence: Synthetic peptide
  Seed: TPMEAELARR (CTG1B_HUMAN)
TSMEAELARR

SEQ ID NO: 30410 - protein, 11 aa, Artificial Sequence
  Description of Artificial Sequence: Synthetic peptide
  Seed: SSCLQQLSLLM (CTG1B_HUMAN)
STCLQQLSLLW

SEQ ID NO: 30411 - protein, 10 aa, Artificial Sequence
  Description of Artificial Sequence: Synthetic peptide
  Seed: LLMWITQCFL (CTG1B_HUMAN)
LVMWITQCFK

SEQ ID NO: 30412 - protein, 10 aa, Artificial Sequence
  Description of Artificial Sequence: Synthetic peptide
  Seed: RASGPGGGAP (CTG1B_HUMAN)
RASGPGGGAF

SEQ ID NO: 30413 - protein, 9 aa, Artificial Sequence
  Description of Artificial Sequence: Synthetic peptide
  Seed: RLLEFYLAM (CTG1B_HUMAN)
RTLEFYLAW

SEQ ID NO: 30414 - protein, 11 aa, Artificial Sequence
  Description of Artificial Sequence: Synthetic peptide
  Seed: FYLAMPFATPM (CTG1B_HUMAN)
FHLAMPFATPY

SEQ ID NO: 30415 - protein, 10 aa, Artificial Sequence
  Description of Artificial Sequence: Synthetic peptide
  Seed: RGPESRLLEF (CTG1B_HUMAN)
RPPESRLLEL

SEQ ID NO: 30416 - protein, 11 aa, Artificial Sequence
  Description of Artificial Sequence: Synthetic peptide
  Seed: RASGPGGGAPR (CTG1B_HUMAN)
RPSGPGGGAPG

SEQ ID NO: 30417 - protein, 9 aa, Artificial Sequence
  Description of Artificial Sequence: Synthetic peptide
  Seed: SLLMWITQC (CTG1B_HUMAN)
STLMWITQV

SEQ ID NO: 30418 - protein, 9 aa, Artificial Sequence
  Description of Artificial Sequence: Synthetic peptide
  Seed: AQDAPPLPV (CTG1B_HUMAN)
AMDAPPLPI

SEQ ID NO: 30419 - protein, 10 aa, Artificial Sequence
  Description of Artificial Sequence: Synthetic peptide
  Seed: RGPHGGAASG (CTG1B_HUMAN)
RNPHGGAASI

SEQ ID NO: 30420 - protein, 9 aa, Artificial Sequence
  Description of Artificial Sequence: Synthetic peptide
  Seed: RLLEFYLAM (CTG1B_HUMAN)
RALEFYLAY

SEQ ID NO: 30421 - protein, 11 aa, Artificial Sequence
  Description of Artificial Sequence: Synthetic peptide
  Seed: RASGPGGGAPR (CTG1B_HUMAN)
RPSGPGGGAPF

SEQ ID NO: 30422 - protein, 10 aa, Artificial Sequence
  Description of Artificial Sequence: Synthetic peptide
  Seed: SLAQDAPPLP (CTG1B_HUMAN)
SLAQDAPPLV

SEQ ID NO: 30423 - protein, 10 aa, Artificial Sequence
  Description of Artificial Sequence: Synthetic peptide
  Seed: LLMWITQCFL (CTG1B_HUMAN)
LDMWITQCFV

SEQ ID NO: 30424 - protein, 9 aa, Artificial Sequence
  Description of Artificial Sequence: Synthetic peptide
  Seed: TVSGNILTI (CTG1B_HUMAN)
TISGNILTR

SEQ ID NO: 30425 - protein, 9 aa, Artificial Sequence
  Description of Artificial Sequence: Synthetic peptide
  Seed: AQDAPPLPV (CTG1B_HUMAN)
AHDAPPLPI

SEQ ID NO: 30426 - protein, 11 aa, Artificial Sequence
  Description of Artificial Sequence: Synthetic peptide
  Seed: SLLMWITQCFL (CTG1B_HUMAN)
SDLMWITQCFV

SEQ ID NO: 30427 - protein, 10 aa, Artificial Sequence
  Description of Artificial Sequence: Synthetic peptide
  Seed: FLAQPPSGQR (CTG1B_HUMAN)
FVAQPPSGQR

SEQ ID NO: 30428 - protein, 9 aa, Artificial Sequence
  Description of Artificial Sequence: Synthetic peptide
  Seed: MPFATPMEA (CTG1B_HUMAN)
MSFATPMEV

SEQ ID NO: 30429 - protein, 10 aa, Artificial Sequence
  Description of Artificial Sequence: Synthetic peptide
  Seed: GIPDGPGGNA (CTG1B_HUMAN)
GTPDGPGGNM

SEQ ID NO: 30430 - protein, 9 aa, Artificial Sequence
  Description of Artificial Sequence: Synthetic peptide
  Seed: TVSGNILTI (CTG1B_HUMAN)
TMSGNILTL

SEQ ID NO: 30431 - protein, 9 aa, Artificial Sequence
  Description of Artificial Sequence: Synthetic peptide
  Seed: SSCLQQLSL (CTG1B_HUMAN)
SACLQQLSL

SEQ ID NO: 30432 - protein, 10 aa, Artificial Sequence
  Description of Artificial Sequence: Synthetic peptide
  Seed: MWITQCFLPV (CTG1B_HUMAN)
MMITQCFLPV

SEQ ID NO: 30433 - protein, 9 aa, Artificial Sequence
  Description of Artificial Sequence: Synthetic peptide
  Seed: RLLEFYLAM (CTG1B_HUMAN)
RELEFYLAY

SEQ ID NO: 30434 - protein, 9 aa, Artificial Sequence
  Description of Artificial Sequence: Synthetic peptide
  Seed: YLAMPFATP (CTG1B_HUMAN)
YQAMPFATT

SEQ ID NO: 30435 - protein, 9 aa, Artificial Sequence
  Description of Artificial Sequence: Synthetic peptide
  Seed: RLLEFYLAM (CTG1B_HUMAN)
RNLEFYLAV

SEQ ID NO: 30436 - protein, 10 aa, Artificial Sequence
  Description of Artificial Sequence: Synthetic peptide
  Seed: RGPHGGAASG (CTG1B_HUMAN)
RPPHGGAASI

SEQ ID NO: 30437 - protein, 9 aa, Artificial Sequence
  Description of Artificial Sequence: Synthetic peptide
  Seed: SGPGGGAPR (CTG1B_HUMAN)
SIPGGGAPR

SEQ ID NO: 30438 - protein, 9 aa, Artificial Sequence
  Description of Artificial Sequence: Synthetic peptide
  Seed: TVSGNILTI (CTG1B_HUMAN)
TQSGNILTM

SEQ ID NO: 30439 - protein, 9 aa, Artificial Sequence
  Description of Artificial Sequence: Synthetic peptide
  Seed: AQDAPPLPV (CTG1B_HUMAN)
AMDAPPLPA

SEQ ID NO: 30440 - protein, 9 aa, Artificial Sequence
  Description of Artificial Sequence: Synthetic peptide
  Seed: AADHRQLQL (CTG1B_HUMAN)
AIDHRQLQI

SEQ ID NO: 30441 - protein, 10 aa, Artificial Sequence
  Description of Artificial Sequence: Synthetic peptide
  Seed: SRLLEFYLAM (CTG1B_HUMAN)
SQLLEFYLAF

SEQ ID NO: 30442 - protein, 9 aa, Artificial Sequence
  Description of Artificial Sequence: Synthetic peptide
  Seed: FLPVFLAQP (CTG1B_HUMAN)
FQPVFLAQA

SEQ ID NO: 30443 - protein, 10 aa, Artificial Sequence
  Description of Artificial Sequence: Synthetic peptide
  Seed: NILTIRLTAA (CTG1B_HUMAN)
NYLTIRLTAV

SEQ ID NO: 30444 - protein, 9 aa, Artificial Sequence
  Description of Artificial Sequence: Synthetic peptide
  Seed: YLAMPFATP (CTG1B_HUMAN)
YMAMPFATT

SEQ ID NO: 30445 - protein, 10 aa, Artificial Sequence
  Description of Artificial Sequence: Synthetic peptide
  Seed: GIPDGPGGNA (CTG1B_HUMAN)
GSPDGPGGNF

SEQ ID NO: 30446 - protein, 9 aa, Artificial Sequence
  Description of Artificial Sequence: Synthetic peptide
  Seed: LEFYLAMPF (CTG1B_HUMAN)
LYFYLAMPM

SEQ ID NO: 30447 - protein, 9 aa, Artificial Sequence
  Description of Artificial Sequence: Synthetic peptide
  Seed: MPFATPMEA (CTG1B_HUMAN)
MSFATPMEF

SEQ ID NO: 30448 - protein, 9 aa, Artificial Sequence
  Description of Artificial Sequence: Synthetic peptide
  Seed: GPRGAGAAR (CTG1B_HUMAN)
GPRGAGAAT

SEQ ID NO: 30449 - protein, 10 aa, Artificial Sequence
  Description of Artificial Sequence: Synthetic peptide
  Seed: APPLPVPGVL (CTG1B_HUMAN)
AYPLPVPGVL

SEQ ID NO: 30450 - protein, 9 aa, Artificial Sequence
  Description of Artificial Sequence: Synthetic peptide
  Seed: WITQCFLPV (CTG1B_HUMAN)
WVTQCFLPI

SEQ ID NO: 30451 - protein, 9 aa, Artificial Sequence
  Description of Artificial Sequence: Synthetic peptide
  Seed: LTAADHRQL (CTG1B_HUMAN)
LAAADHRQM

SEQ ID NO: 30452 - protein, 10 aa, Artificial Sequence
  Description of Artificial Sequence: Synthetic peptide
  Seed: AMPFATPMEA (CTG1B_HUMAN)
AMPFATPMEF

SEQ ID NO: 30453 - protein, 9 aa, Artificial Sequence
  Description of Artificial Sequence: Synthetic peptide
  Seed: LPVPGVLLK (CTG1B_HUMAN)
LTVPGVLLM

SEQ ID NO: 30454 - protein, 10 aa, Artificial Sequence
  Description of Artificial Sequence: Synthetic peptide
  Seed: GAPRGPHGGA (CTG1B_HUMAN)
GTPRGPHGGM

SEQ ID NO: 30455 - protein, 10 aa, Artificial Sequence
  Description of Artificial Sequence: Synthetic peptide
  Seed: YLAMPFATPM (CTG1B_HUMAN)
YNAMPFATPV

SEQ ID NO: 30456 - protein, 10 aa, Artificial Sequence
  Description of Artificial Sequence: Synthetic peptide
  Seed: RGPHGGAASG (CTG1B_HUMAN)
RFPHGGAASV

SEQ ID NO: 30457 - protein, 9 aa, Artificial Sequence
  Description of Artificial Sequence: Synthetic peptide
  Seed: SLAQDAPPL (CTG1B_HUMAN)
SHAQDAPPY

SEQ ID NO: 30458 - protein, 10 aa, Artificial Sequence
  Description of Artificial Sequence: Synthetic peptide
  Seed: LLMWITQCFL (CTG1B_HUMAN)
LMMWITQCFM

SEQ ID NO: 30459 - protein, 9 aa, Artificial Sequence
  Description of Artificial Sequence: Synthetic peptide
  Seed: LAMPFATPM (CTG1B_HUMAN)
LTMPFATPY

SEQ ID NO: 30460 - protein, 9 aa, Artificial Sequence
  Description of Artificial Sequence: Synthetic peptide
  Seed: AADHRQLQL (CTG1B_HUMAN)
AYDHRQLQM

SEQ ID NO: 30461 - protein, 11 aa, Artificial Sequence
  Description of Artificial Sequence: Synthetic peptide
  Seed: FYLAMPFATPM (CTG1B_HUMAN)
FMLAMPFATPM

SEQ ID NO: 30462 - protein, 10 aa, Artificial Sequence
  Description of Artificial Sequence: Synthetic peptide
  Seed: WITQCFLPVF (CTG1B_HUMAN)
WKTQCFLPVF

SEQ ID NO: 30463 - protein, 9 aa, Artificial Sequence
  Description of Artificial Sequence: Synthetic peptide
  Seed: FATPMEAEL (CTG1B_HUMAN)
FFTPMEAEF

SEQ ID NO: 30464 - protein, 11 aa, Artificial Sequence
  Description of Artificial Sequence: Synthetic peptide
  Seed: FYLAMPFATPM (CTG1B_HUMAN)
FLLAMPFATPM

SEQ ID NO: 30465 - protein, 10 aa, Artificial Sequence
  Description of Artificial Sequence: Synthetic peptide
  Seed: SLLMWITQCF (CTG1B_HUMAN)
SFLMWITQCY

SEQ ID NO: 30466 - protein, 9 aa, Artificial Sequence
  Description of Artificial Sequence: Synthetic peptide
  Seed: RQLQLSISS (CTG1B_HUMAN)
RRLQLSISY

SEQ ID NO: 30467 - protein, 9 aa, Artificial Sequence
  Description of Artificial Sequence: Synthetic peptide
  Seed: FLPVFLAQP (CTG1B_HUMAN)
FAPVFLAQA

SEQ ID NO: 30468 - protein, 9 aa, Artificial Sequence
  Description of Artificial Sequence: Synthetic peptide
  Seed: SLAQDAPPL (CTG1B_HUMAN)
SIAQDAPPI

SEQ ID NO: 30469 - protein, 10 aa, Artificial Sequence
  Description of Artificial Sequence: Synthetic peptide
  Seed: RGPHGGAASG (CTG1B_HUMAN)
RKPHGGAASM

SEQ ID NO: 30470 - protein, 9 aa, Artificial Sequence
  Description of Artificial Sequence: Synthetic peptide
  Seed: MPFATPMEA (CTG1B_HUMAN)
MMFATPMEM

SEQ ID NO: 30471 - protein, 10 aa, Artificial Sequence
  Description of Artificial Sequence: Synthetic peptide
  Seed: LQQLSLLMWI (CTG1B_HUMAN)
LAQLSLLMWV

SEQ ID NO: 30472 - protein, 9 aa, Artificial Sequence
  Description of Artificial Sequence: Synthetic peptide
  Seed: LPVPGVLLK (CTG1B_HUMAN)
LAVPGVLLL

SEQ ID NO: 30473 - protein, 10 aa, Artificial Sequence
  Description of Artificial Sequence: Synthetic peptide
  Seed: AMPFATPMEA (CTG1B_HUMAN)
AQPFATPMEY

SEQ ID NO: 30474 - protein, 11 aa, Artificial Sequence
  Description of Artificial Sequence: Synthetic peptide
  Seed: APRGPHGGAAS (CTG1B_HUMAN)
APRGPHGGAAC

SEQ ID NO: 30475 - protein, 11 aa, Artificial Sequence
  Description of Artificial Sequence: Synthetic peptide
  Seed: RLLEFYLAMPF (CTG1B_HUMAN)
RWLEFYLAMPF

SEQ ID NO: 30476 - protein, 10 aa, Artificial Sequence
  Description of Artificial Sequence: Synthetic peptide
  Seed: FLPVFLAQPP (CTG1B_HUMAN)
FAPVFLAQPT

SEQ ID NO: 30477 - protein, 9 aa, Artificial Sequence
  Description of Artificial Sequence: Synthetic peptide
  Seed: LAMPFATPM (CTG1B_HUMAN)
LNMPFATPY

SEQ ID NO: 30478 - protein, 9 aa, Artificial Sequence
  Description of Artificial Sequence: Synthetic peptide
  Seed: SLLMWITQC (CTG1B_HUMAN)
SMLMWITQS

SEQ ID NO: 30479 - protein, 10 aa, Artificial Sequence
  Description of Artificial Sequence: Synthetic peptide
  Seed: LLEFYLAMPF (CTG1B_HUMAN)
LKEFYLAMPM

SEQ ID NO: 30480 - protein, 9 aa, Artificial Sequence
  Description of Artificial Sequence: Synthetic peptide
  Seed: LQLSISSCL (CTG1B_HUMAN)
LALSISSCV

SEQ ID NO: 30481 - protein, 9 aa, Artificial Sequence
  Description of Artificial Sequence: Synthetic peptide
  Seed: LAMPFATPM (CTG1B_HUMAN)
LIMPFATPR

SEQ ID NO: 30482 - protein, 10 aa, Artificial Sequence
  Description of Artificial Sequence: Synthetic peptide
  Seed: AMPFATPMEA (CTG1B_HUMAN)
ALPFATPMEF

SEQ ID NO: 30483 - protein, 10 aa, Artificial Sequence
  Description of Artificial Sequence: Synthetic peptide
  Seed: APPLPVPGVL (CTG1B_HUMAN)
AWPLPVPGVL

SEQ ID NO: 30484 - protein, 10 aa, Artificial Sequence
  Description of Artificial Sequence: Synthetic peptide
  Seed: YLAMPFATPM (CTG1B_HUMAN)
YHAMPFATPV

SEQ ID NO: 30485 - protein, 10 aa, Artificial Sequence
  Description of Artificial Sequence: Synthetic peptide
  Seed: LAMPFATPME (CTG1B_HUMAN)
LSMPFATPMM

SEQ ID NO: 30486 - protein, 9 aa, Artificial Sequence
  Description of Artificial Sequence: Synthetic peptide
  Seed: FATPMEAEL (CTG1B_HUMAN)
FRTPMEAEL

SEQ ID NO: 30487 - protein, 10 aa, Artificial Sequence
  Description of Artificial Sequence: Synthetic peptide
  Seed: FLPVFLAQPP (CTG1B_HUMAN)
FPPVFLAQPT

SEQ ID NO: 30488 - protein, 9 aa, Artificial Sequence
  Description of Artificial Sequence: Synthetic peptide
  Seed: SISSCLQQL (CTG1B_HUMAN)
SLSSCLQQF

SEQ ID NO: 30489 - protein, 9 aa, Artificial Sequence
  Description of Artificial Sequence: Synthetic peptide
  Seed: LQLSISSCL (CTG1B_HUMAN)
LKLSISSCY

SEQ ID NO: 30490 - protein, 9 aa, Artificial Sequence
  Description of Artificial Sequence: Synthetic peptide
  Seed: LEFYLAMPF (CTG1B_HUMAN)
LPFYLAMPG

SEQ ID NO: 30491 - protein, 9 aa, Artificial Sequence
  Description of Artificial Sequence: Synthetic peptide
  Seed: QQLSLLMWI (CTG1B_HUMAN)
QLLSLLMWI

SEQ ID NO: 30492 - protein, 9 aa, Artificial Sequence
  Description of Artificial Sequence: Synthetic peptide
  Seed: APPLPVPGV (CTG1B_HUMAN)
APPLPVPGL

SEQ ID NO: 30493 - protein, 10 aa, Artificial Sequence
  Description of Artificial Sequence: Synthetic peptide
  Seed: FYLAMPFATP (CTG1B_HUMAN)
FHLAMPFATM

SEQ ID NO: 30494 - protein, 9 aa, Artificial Sequence
  Description of Artificial Sequence: Synthetic peptide
  Seed: SLAQDAPPL (CTG1B_HUMAN)
SQAQDAPPM

SEQ ID NO: 30495 - protein, 10 aa, Artificial Sequence
  Description of Artificial Sequence: Synthetic peptide
  Seed: LLMWITQCFL (CTG1B_HUMAN)
LGMWITQCFV

SEQ ID NO: 30496 - protein, 10 aa, Artificial Sequence
  Description of Artificial Sequence: Synthetic peptide
  Seed: LLMWITQCFL (CTG1B_HUMAN)
LIMWITQCFL

SEQ ID NO: 30497 - protein, 9 aa, Artificial Sequence
  Description of Artificial Sequence: Synthetic peptide
  Seed: TAADHRQLQ (CTG1B_HUMAN)
TSADHRQLF

SEQ ID NO: 30498 - protein, 9 aa, Artificial Sequence
  Description of Artificial Sequence: Synthetic peptide
  Seed: SSCLQQLSL (CTG1B_HUMAN)
SQCLQQLSM

SEQ ID NO: 30499 - protein, 9 aa, Artificial Sequence
  Description of Artificial Sequence: Synthetic peptide
  Seed: SGPGGGAPR (CTG1B_HUMAN)
SIPGGGAPK

SEQ ID NO: 30500 - protein, 10 aa, Artificial Sequence
  Description of Artificial Sequence: Synthetic peptide
  Seed: KEFTVSGNIL (CTG1B_HUMAN)
KEFTVSGNIV

SEQ ID NO: 30501 - protein, 9 aa, Artificial Sequence
  Description of Artificial Sequence: Synthetic peptide
  Seed: SSCLQQLSL (CTG1B_HUMAN)
SDCLQQLSL

SEQ ID NO: 30502 - protein, 10 aa, Artificial Sequence
  Description of Artificial Sequence: Synthetic peptide
  Seed: KEFTVSGNIL (CTG1B_HUMAN)
KKFTVSGNIF

SEQ ID NO: 30503 - protein, 9 aa, Artificial Sequence
  Description of Artificial Sequence: Synthetic peptide
  Seed: LAMPFATPM (CTG1B_HUMAN)
LQMPFATPF

SEQ ID NO: 30504 - protein, 10 aa, Artificial Sequence
  Description of Artificial Sequence: Synthetic peptide
  Seed: RGPHGGAASG (CTG1B_HUMAN)
RCPHGGAASI

SEQ ID NO: 30505 - protein, 9 aa, Artificial Sequence
  Description of Artificial Sequence: Synthetic peptide
  Seed: RLLEFYLAM (CTG1B_HUMAN)
RGLEFYLAF

SEQ ID NO: 30506 - protein, 9 aa, Artificial Sequence
  Description of Artificial Sequence: Synthetic peptide
  Seed: LEFYLAMPF (CTG1B_HUMAN)
LKFYLAMPL

SEQ ID NO: 30507 - protein, 10 aa, Artificial Sequence
  Description of Artificial Sequence: Synthetic peptide
  Seed: FTVSGNILTI (CTG1B_HUMAN)
FGVSGNILTM

SEQ ID NO: 30508 - protein, 10 aa, Artificial Sequence
  Description of Artificial Sequence: Synthetic peptide
  Seed: RGPESRLLEF (CTG1B_HUMAN)
RLPESRLLEM

SEQ ID NO: 30509 - protein, 9 aa, Artificial Sequence
  Description of Artificial Sequence: Synthetic peptide
  Seed: LAMPFATPM (CTG1B_HUMAN)
LKMPFATPW

SEQ ID NO: 30510 - protein, 9 aa, Artificial Sequence
  Description of Artificial Sequence: Synthetic peptide
  Seed: AARASGPGG (CTG1B_HUMAN)
AYRASGPGV

SEQ ID NO: 30511 - protein, 9 aa, Artificial Sequence
  Description of Artificial Sequence: Synthetic peptide
  Seed: AQDAPPLPV (CTG1B_HUMAN)
ALDAPPLPM

SEQ ID NO: 30512 - protein, 9 aa, Artificial Sequence
  Description of Artificial Sequence: Synthetic peptide
  Seed: MQAEGRGTG (CTG1B_HUMAN)
MQAEGRGTM

SEQ ID NO: 30513 - protein, 9 aa, Artificial Sequence
  Description of Artificial Sequence: Synthetic peptide
  Seed: MPFATPMEA (CTG1B_HUMAN)
MQFATPMEF

SEQ ID NO: 30514 - protein, 9 aa, Artificial Sequence
  Description of Artificial Sequence: Synthetic peptide
  Seed: LLMWITQCF (CTG1B_HUMAN)
LTMWITQCM

SEQ ID NO: 30515 - protein, 11 aa, Artificial Sequence
  Description of Artificial Sequence: Synthetic peptide
  Seed: FYLAMPFATPM (CTG1B_HUMAN)
FKLAMPFATPL

SEQ ID NO: 30516 - protein, 9 aa, Artificial Sequence
  Description of Artificial Sequence: Synthetic peptide
  Seed: AQDAPPLPV (CTG1B_HUMAN)
AQDAPPLPL

SEQ ID NO: 30517 - protein, 9 aa, Artificial Sequence
  Description of Artificial Sequence: Synthetic peptide
  Seed: TVSGNILTI (CTG1B_HUMAN)
TQSGNILTY

SEQ ID NO: 30518 - protein, 11 aa, Artificial Sequence
  Description of Artificial Sequence: Synthetic peptide
  Seed: AARASGPGGGA (CTG1B_HUMAN)
ASRASGPGGGF

SEQ ID NO: 30519 - protein, 9 aa, Artificial Sequence
  Description of Artificial Sequence: Synthetic peptide
  Seed: LQLSISSCL (CTG1B_HUMAN)
LTLSISSCY

SEQ ID NO: 30520 - protein, 9 aa, Artificial Sequence
  Description of Artificial Sequence: Synthetic peptide
  Seed: AQDAPPLPV (CTG1B_HUMAN)
ASDAPPLPI

SEQ ID NO: 30521 - protein, 10 aa, Artificial Sequence
  Description of Artificial Sequence: Synthetic peptide
  Seed: LAMPFATPME (CTG1B_HUMAN)
LAMPFATPMF

SEQ ID NO: 30522 - protein, 10 aa, Artificial Sequence
  Description of Artificial Sequence: Synthetic peptide
  Seed: LLMWITQCFL (CTG1B_HUMAN)
LIMWITQCFI

SEQ ID NO: 30523 - protein, 9 aa, Artificial Sequence
  Description of Artificial Sequence: Synthetic peptide
  Seed: FATPMEAEL (CTG1B_HUMAN)
FFTPMEAEL

SEQ ID NO: 30524 - protein, 9 aa, Artificial Sequence
  Description of Artificial Sequence: Synthetic peptide
  Seed: TPMEAELAR (CTG1B_HUMAN)
TPMEAELAA

SEQ ID NO: 30525 - protein, 9 aa, Artificial Sequence
  Description of Artificial Sequence: Synthetic peptide
  Seed: ASGPGGGAP (CTG1B_HUMAN)
AAGPGGGAA

SEQ ID NO: 30526 - protein, 9 aa, Artificial Sequence
  Description of Artificial Sequence: Synthetic peptide
  Seed: IPDGPGGNA (CTG1B_HUMAN)
IFDGPGGNL

SEQ ID NO: 30527 - protein, 11 aa, Artificial Sequence
  Description of Artificial Sequence: Synthetic peptide
  Seed: IPDGPGGNAGG (CTG1B_HUMAN)
IADGPGGNAGY

SEQ ID NO: 30528 - protein, 9 aa, Artificial Sequence
  Description of Artificial Sequence: Synthetic peptide
  Seed: FATPMEAEL (CTG1B_HUMAN)
FPTPMEAEF

SEQ ID NO: 30529 - protein, 11 aa, Artificial Sequence
  Description of Artificial Sequence: Synthetic peptide
  Seed: RLLEFYLAMPF (CTG1B_HUMAN)
RELEFYLAMPW

SEQ ID NO: 30530 - protein, 11 aa, Artificial Sequence
  Description of Artificial Sequence: Synthetic peptide
  Seed: RLLEFYLAMPF (CTG1B_HUMAN)
RMLEFYLAMPV

SEQ ID NO: 30531 - protein, 9 aa, Artificial Sequence
  Description of Artificial Sequence: Synthetic peptide
  Seed: SSCLQQLSL (CTG1B_HUMAN)
SACLQQLSW

SEQ ID NO: 30532 - protein, 9 aa, Artificial Sequence
  Description of Artificial Sequence: Synthetic peptide
  Seed: SISSCLQQL (CTG1B_HUMAN)
SMSSCLQQI

SEQ ID NO: 30533 - protein, 9 aa, Artificial Sequence
  Description of Artificial Sequence: Synthetic peptide
  Seed: YLAMPFATP (CTG1B_HUMAN)
YTAMPFATA

SEQ ID NO: 30534 - protein, 9 aa, Artificial Sequence
  Description of Artificial Sequence: Synthetic peptide
  Seed: CLQQLSLLM (CTG1B_HUMAN)
CMQQLSLLY

SEQ ID NO: 30535 - protein, 10 aa, Artificial Sequence
  Description of Artificial Sequence: Synthetic peptide
  Seed: RGPHGGAASG (CTG1B_HUMAN)
RGPHGGAASV

SEQ ID NO: 30536 - protein, 10 aa, Artificial Sequence
  Description of Artificial Sequence: Synthetic peptide
  Seed: TVSGNILTIR (CTG1B_HUMAN)
TASGNILTIK

SEQ ID NO: 30537 - protein, 10 aa, Artificial Sequence
  Description of Artificial Sequence: Synthetic peptide
  Seed: SLAQDAPPLP (CTG1B_HUMAN)
SLAQDAPPLL

SEQ ID NO: 30538 - protein, 10 aa, Artificial Sequence
  Description of Artificial Sequence: Synthetic peptide
  Seed: LLEFYLAMPF (CTG1B_HUMAN)
LMEFYLAMPF

SEQ ID NO: 30539 - protein, 11 aa, Artificial Sequence
  Description of Artificial Sequence: Synthetic peptide
  Seed: MWITQCFLPVF (CTG1B_HUMAN)
MYITQCFLPVL

SEQ ID NO: 30540 - protein, 11 aa, Artificial Sequence
  Description of Artificial Sequence: Synthetic peptide
  Seed: RLLEFYLAMPF (CTG1B_HUMAN)
RWLEFYLAMPY

SEQ ID NO: 30541 - protein, 11 aa, Artificial Sequence
  Description of Artificial Sequence: Synthetic peptide
  Seed: RASGPGGGAPR (CTG1B_HUMAN)
RPSGPGGGAPV

SEQ ID NO: 30542 - protein, 9 aa, Artificial Sequence
  Description of Artificial Sequence: Synthetic peptide
  Seed: YLAMPFATP (CTG1B_HUMAN)
YLAMPFATS

SEQ ID NO: 30543 - protein, 10 aa, Artificial Sequence
  Description of Artificial Sequence: Synthetic peptide
  Seed: APPLPVPGVL (CTG1B_HUMAN)
ALPLPVPGVL

SEQ ID NO: 30544 - protein, 9 aa, Artificial Sequence
  Description of Artificial Sequence: Synthetic peptide
  Seed: AARASGPGG (CTG1B_HUMAN)
ATRASGPGL

SEQ ID NO: 30545 - protein, 9 aa, Artificial Sequence
  Description of Artificial Sequence: Synthetic peptide
  Seed: SLAQDAPPL (CTG1B_HUMAN)
SVAQDAPPL

SEQ ID NO: 30546 - protein, 9 aa, Artificial Sequence
  Description of Artificial Sequence: Synthetic peptide
  Seed: FATPMEAEL (CTG1B_HUMAN)
FVTPMEAEI

SEQ ID NO: 30547 - protein, 10 aa, Artificial Sequence
  Description of Artificial Sequence: Synthetic peptide
  Seed: LEFYLAMPFA (CTG1B_HUMAN)
LHFYLAMPFF

SEQ ID NO: 30548 - protein, 9 aa, Artificial Sequence
  Description of Artificial Sequence: Synthetic peptide
  Seed: LAMPFATPM (CTG1B_HUMAN)
LSMPFATPH

SEQ ID NO: 30549 - protein, 10 aa, Artificial Sequence
  Description of Artificial Sequence: Synthetic peptide
  Seed: RGPHGGAASG (CTG1B_HUMAN)
RKPHGGAASA

SEQ ID NO: 30550 - protein, 9 aa, Artificial Sequence
  Description of Artificial Sequence: Synthetic peptide
  Seed: SGPGGGAPR (CTG1B_HUMAN)
SAPGGGAPK

SEQ ID NO: 30551 - protein, 9 aa, Artificial Sequence
  Description of Artificial Sequence: Synthetic peptide
  Seed: TVSGNILTI (CTG1B_HUMAN)
TRSGNILTM

SEQ ID NO: 30552 - protein, 11 aa, Artificial Sequence
  Description of Artificial Sequence: Synthetic peptide
  Seed: FYLAMPFATPM (CTG1B_HUMAN)
FLLAMPFATPF

SEQ ID NO: 30553 - protein, 10 aa, Artificial Sequence
  Description of Artificial Sequence: Synthetic peptide
  Seed: MPFATPMEAE (CTG1B_HUMAN)
MPFATPMEAW

SEQ ID NO: 30554 - protein, 10 aa, Artificial Sequence
  Description of Artificial Sequence: Synthetic peptide
  Seed: RSLAQDAPPL (CTG1B_HUMAN)
RCLAQDAPPV

SEQ ID NO: 30555 - protein, 9 aa, Artificial Sequence
  Description of Artificial Sequence: Synthetic peptide
  Seed: LTAADHRQL (CTG1B_HUMAN)
LVAADHRQW

SEQ ID NO: 30556 - protein, 9 aa, Artificial Sequence
  Description of Artificial Sequence: Synthetic peptide
  Seed: QQLSLLMWI (CTG1B_HUMAN)
QRLSLLMWI

SEQ ID NO: 30557 - protein, 9 aa, Artificial Sequence
  Description of Artificial Sequence: Synthetic peptide
  Seed: LLMWITQCF (CTG1B_HUMAN)
LPMWITQCY

SEQ ID NO: 30558 - protein, 9 aa, Artificial Sequence
  Description of Artificial Sequence: Synthetic peptide
  Seed: FLPVFLAQP (CTG1B_HUMAN)
FVPVFLAQA

SEQ ID NO: 30559 - protein, 9 aa, Artificial Sequence
  Description of Artificial Sequence: Synthetic peptide
  Seed: LAMPFATPM (CTG1B_HUMAN)
LCMPFATPY

SEQ ID NO: 30560 - protein, 10 aa, Artificial Sequence
  Description of Artificial Sequence: Synthetic peptide
  Seed: YLAMPFATPM (CTG1B_HUMAN)
YSAMPFATPY

SEQ ID NO: 30561 - protein, 8 aa, Artificial Sequence
  Description of Artificial Sequence: Synthetic peptide
  Seed: FTVSGNIL (CTG1B_HUMAN)
FSVSGNIL

SEQ ID NO: 30562 - protein, 11 aa, Artificial Sequence
  Description of Artificial Sequence: Synthetic peptide
  Seed: APRGPHGGAAS (CTG1B_HUMAN)
APRGPHGGAAP

SEQ ID NO: 30563 - protein, 10 aa, Artificial Sequence
  Description of Artificial Sequence: Synthetic peptide
  Seed: YLAMPFATPM (CTG1B_HUMAN)
YRAMPFATPI

SEQ ID NO: 30564 - protein, 11 aa, Artificial Sequence
  Description of Artificial Sequence: Synthetic peptide
  Seed: YLAMPFATPME (CTG1B_HUMAN)
YMAMPFATPMV

SEQ ID NO: 30565 - protein, 9 aa, Artificial Sequence
  Description of Artificial Sequence: Synthetic peptide
  Seed: TVSGNILTI (CTG1B_HUMAN)
TSSGNILTM

SEQ ID NO: 30566 - protein, 9 aa, Artificial Sequence
  Description of Artificial Sequence: Synthetic peptide
  Seed: MPFATPMEA (CTG1B_HUMAN)
MVFATPMEF

SEQ ID NO: 30567 - protein, 9 aa, Artificial Sequence
  Description of Artificial Sequence: Synthetic peptide
  Seed: QQLSLLMWI (CTG1B_HUMAN)
QMLSLLMWL

SEQ ID NO: 30568 - protein, 9 aa, Artificial Sequence
  Description of Artificial Sequence: Synthetic peptide
  Seed: AADHRQLQL (CTG1B_HUMAN)
AIDHRQLQL

SEQ ID NO: 30569 - protein, 9 aa, Artificial Sequence
  Description of Artificial Sequence: Synthetic peptide
  Seed: IPDGPGGNA (CTG1B_HUMAN)
IIDGPGGNF

SEQ ID NO: 30570 - protein, 10 aa, Artificial Sequence
  Description of Artificial Sequence: Synthetic peptide
  Seed: FLPVFLAQPP (CTG1B_HUMAN)
FHPVFLAQPA

SEQ ID NO: 30571 - protein, 9 aa, Artificial Sequence
  Description of Artificial Sequence: Synthetic peptide
  Seed: APPLPVPGV (CTG1B_HUMAN)
ALPLPVPGL

SEQ ID NO: 30572 - protein, 11 aa, Artificial Sequence
  Description of Artificial Sequence: Synthetic peptide
  Seed: LTAADHRQLQL (CTG1B_HUMAN)
LGAADHRQLQW

SEQ ID NO: 30573 - protein, 9 aa, Artificial Sequence
  Description of Artificial Sequence: Synthetic peptide
  Seed: MQAEGRGTG (CTG1B_HUMAN)
MKAEGRGTM

SEQ ID NO: 30574 - protein, 10 aa, Artificial Sequence
  Description of Artificial Sequence: Synthetic peptide
  Seed: KEFTVSGNIL (CTG1B_HUMAN)
KHFTVSGNIY

SEQ ID NO: 30575 - protein, 10 aa, Artificial Sequence
  Description of Artificial Sequence: Synthetic peptide
  Seed: RSLAQDAPPL (CTG1B_HUMAN)
RTLAQDAPPV

SEQ ID NO: 30576 - protein, 9 aa, Artificial Sequence
  Description of Artificial Sequence: Synthetic peptide
  Seed: TVSGNILTI (CTG1B_HUMAN)
TMSGNILTI

SEQ ID NO: 30577 - protein, 10 aa, Artificial Sequence
  Description of Artificial Sequence: Synthetic peptide
  Seed: YLAMPFATPM (CTG1B_HUMAN)
YIAMPFATPR

SEQ ID NO: 30578 - protein, 9 aa, Artificial Sequence
  Description of Artificial Sequence: Synthetic peptide
  Seed: TVSGNILTI (CTG1B_HUMAN)
TMSGNILTW

SEQ ID NO: 30579 - protein, 11 aa, Artificial Sequence
  Description of Artificial Sequence: Synthetic peptide
  Seed: LAMPFATPMEA (CTG1B_HUMAN)
LTMPFATPMEA

SEQ ID NO: 30580 - protein, 9 aa, Artificial Sequence
  Description of Artificial Sequence: Synthetic peptide
  Seed: SISSCLQQL (CTG1B_HUMAN)
SVSSCLQQR

SEQ ID NO: 30581 - protein, 9 aa, Artificial Sequence
  Description of Artificial Sequence: Synthetic peptide
  Seed: TQCFLPVFL (CTG1B_HUMAN)
TVCFLPVFI

SEQ ID NO: 30582 - protein, 9 aa, Artificial Sequence
  Description of Artificial Sequence: Synthetic peptide
  Seed: TPMEAELAR (CTG1B_HUMAN)
TVMEAELAR

SEQ ID NO: 30583 - protein, 10 aa, Artificial Sequence
  Description of Artificial Sequence: Synthetic peptide
  Seed: RSLAQDAPPL (CTG1B_HUMAN)
RMLAQDAPPW

SEQ ID NO: 30584 - protein, 9 aa, Artificial Sequence
  Description of Artificial Sequence: Synthetic peptide
  Seed: GVLLKEFTV (CTG1B_HUMAN)
GLLLKEFTL

SEQ ID NO: 30585 - protein, 11 aa, Artificial Sequence
  Description of Artificial Sequence: Synthetic peptide
  Seed: RLLEFYLAMPF (CTG1B_HUMAN)
RLLEFYLAMPM

SEQ ID NO: 30586 - protein, 10 aa, Artificial Sequence
  Description of Artificial Sequence: Synthetic peptide
  Seed: LEFYLAMPFA (CTG1B_HUMAN)
LQFYLAMPFN

SEQ ID NO: 30587 - protein, 11 aa, Artificial Sequence
  Description of Artificial Sequence: Synthetic peptide
  Seed: LAMPFATPMEA (CTG1B_HUMAN)
LSMPFATPMEA

SEQ ID NO: 30588 - protein, 9 aa, Artificial Sequence
  Description of Artificial Sequence: Synthetic peptide
  Seed: TVSGNILTI (CTG1B_HUMAN)
TASGNILTY

SEQ ID NO: 30589 - protein, 8 aa, Artificial Sequence
  Description of Artificial Sequence: Synthetic peptide
  Seed: VSGNILTI (CTG1B_HUMAN)
VQGNILTV

SEQ ID NO: 30590 - protein, 9 aa, Artificial Sequence
  Description of Artificial Sequence: Synthetic peptide
  Seed: SISSCLQQL (CTG1B_HUMAN)
SVSSCLQQW

SEQ ID NO: 30591 - protein, 9 aa, Artificial Sequence
  Description of Artificial Sequence: Synthetic peptide
  Seed: SSCLQQLSL (CTG1B_HUMAN)
STCLQQLSW

SEQ ID NO: 30592 - protein, 9 aa, Artificial Sequence
  Description of Artificial Sequence: Synthetic peptide
  Seed: YLAMPFATP (CTG1B_HUMAN)
YMAMPFATL

SEQ ID NO: 30593 - protein, 10 aa, Artificial Sequence
  Description of Artificial Sequence: Synthetic peptide
  Seed: YLAMPFATPM (CTG1B_HUMAN)
YTAMPFATPK

SEQ ID NO: 30594 - protein, 10 aa, Artificial Sequence
  Description of Artificial Sequence: Synthetic peptide
  Seed: MWITQCFLPV (CTG1B_HUMAN)
MMITQCFLPL

SEQ ID NO: 30595 - protein, 9 aa, Artificial Sequence
  Description of Artificial Sequence: Synthetic peptide
  Seed: MPFATPMEA (CTG1B_HUMAN)
MAFATPMEF

SEQ ID NO: 30596 - protein, 10 aa, Artificial Sequence
  Description of Artificial Sequence: Synthetic peptide
  Seed: LLEFYLAMPF (CTG1B_HUMAN)
LMEFYLAMPL

SEQ ID NO: 30597 - protein, 9 aa, Artificial Sequence
  Description of Artificial Sequence: Synthetic peptide
  Seed: SLLMWITQC (CTG1B_HUMAN)
SILMWITQI

SEQ ID NO: 30598 - protein, 10 aa, Artificial Sequence
  Description of Artificial Sequence: Synthetic peptide
  Seed: LEFYLAMPFA (CTG1B_HUMAN)
LRFYLAMPFY

SEQ ID NO: 30599 - protein, 11 aa, Artificial Sequence
  Description of Artificial Sequence: Synthetic peptide
  Seed: FYLAMPFATPM (CTG1B_HUMAN)
FCLAMPFATPL

SEQ ID NO: 30600 - protein, 9 aa, Artificial Sequence
  Description of Artificial Sequence: Synthetic peptide
  Seed: RLLEFYLAM (CTG1B_HUMAN)
RKLEFYLAH

SEQ ID NO: 30601 - protein, 9 aa, Artificial Sequence
  Description of Artificial Sequence: Synthetic peptide
  Seed: FATPMEAEL (CTG1B_HUMAN)
FQTPMEAEL

SEQ ID NO: 30602 - protein, 10 aa, Artificial Sequence
  Description of Artificial Sequence: Synthetic peptide
  Seed: MWITQCFLPV (CTG1B_HUMAN)
MFITQCFLPF

SEQ ID NO: 30603 - protein, 9 aa, Artificial Sequence
  Description of Artificial Sequence: Synthetic peptide
  Seed: MQAEGRGTG (CTG1B_HUMAN)
MQAEGRGTV

SEQ ID NO: 30604 - protein, 9 aa, Artificial Sequence
  Description of Artificial Sequence: Synthetic peptide
  Seed: APPLPVPGV (CTG1B_HUMAN)
AAPLPVPGI

SEQ ID NO: 30605 - protein, 9 aa, Artificial Sequence
  Description of Artificial Sequence: Synthetic peptide
  Seed: ITQCFLPVF (CTG1B_HUMAN)
IWQCFLPVM

SEQ ID NO: 30606 - protein, 9 aa, Artificial Sequence
  Description of Artificial Sequence: Synthetic peptide
  Seed: RQLQLSISS (CTG1B_HUMAN)
RVLQLSISV

SEQ ID NO: 30607 - protein, 9 aa, Artificial Sequence
  Description of Artificial Sequence: Synthetic peptide
  Seed: WITQCFLPV (CTG1B_HUMAN)
WTTQCFLPI

SEQ ID NO: 30608 - protein, 10 aa, Artificial Sequence
  Description of Artificial Sequence: Synthetic peptide
  Seed: LLMWITQCFL (CTG1B_HUMAN)
LTMWITQCFR

SEQ ID NO: 30609 - protein, 10 aa, Artificial Sequence
  Description of Artificial Sequence: Synthetic peptide
  Seed: LLEFYLAMPF (CTG1B_HUMAN)
LNEFYLAMPW

SEQ ID NO: 30610 - protein, 9 aa, Artificial Sequence
  Description of Artificial Sequence: Synthetic peptide
  Seed: FATPMEAEL (CTG1B_HUMAN)
FTTPMEAEL

SEQ ID NO: 30611 - protein, 11 aa, Artificial Sequence
  Description of Artificial Sequence: Synthetic peptide
  Seed: GAPRGPHGGAA (CTG1B_HUMAN)
GMPRGPHGGAM

SEQ ID NO: 30612 - protein, 9 aa, Artificial Sequence
  Description of Artificial Sequence: Synthetic peptide
  Seed: LPVPGVLLK (CTG1B_HUMAN)
LAVPGVLLF

SEQ ID NO: 30613 - protein, 8 aa, Artificial Sequence
  Description of Artificial Sequence: Synthetic peptide
  Seed: FTVSGNIL (CTG1B_HUMAN)
FAVSGNIF

SEQ ID NO: 30614 - protein, 9 aa, Artificial Sequence
  Description of Artificial Sequence: Synthetic peptide
  Seed: MPFATPMEA (CTG1B_HUMAN)
MLFATPMEV

SEQ ID NO: 30615 - protein, 10 aa, Artificial Sequence
  Description of Artificial Sequence: Synthetic peptide
  Seed: LAQDAPPLPV (CTG1B_HUMAN)
LAQDAPPLPM

SEQ ID NO: 30616 - protein, 10 aa, Artificial Sequence
  Description of Artificial Sequence: Synthetic peptide
  Seed: YLAMPFATPM (CTG1B_HUMAN)
YAAMPFATPW

SEQ ID NO: 30617 - protein, 10 aa, Artificial Sequence
  Description of Artificial Sequence: Synthetic peptide
  Seed: YLAMPFATPM (CTG1B_HUMAN)
YRAMPFATPM

SEQ ID NO: 30618 - protein, 9 aa, Artificial Sequence
  Description of Artificial Sequence: Synthetic peptide
  Seed: SRLLEFYLA (CTG1B_HUMAN)
SRLLEFYLI

SEQ ID NO: 30619 - protein, 9 aa, Artificial Sequence
  Description of Artificial Sequence: Synthetic peptide
  Seed: LQLSISSCL (CTG1B_HUMAN)
LMLSISSCL

SEQ ID NO: 30620 - protein, 9 aa, Artificial Sequence
  Description of Artificial Sequence: Synthetic peptide
  Seed: AQDAPPLPV (CTG1B_HUMAN)
AGDAPPLPV

SEQ ID NO: 30621 - protein, 9 aa, Artificial Sequence
  Description of Artificial Sequence: Synthetic peptide
  Seed: LPVPGVLLK (CTG1B_HUMAN)
LVVPGVLLL

SEQ ID NO: 30622 - protein, 9 aa, Artificial Sequence
  Description of Artificial Sequence: Synthetic peptide
  Seed: APPLPVPGV (CTG1B_HUMAN)
AQPLPVPGV

SEQ ID NO: 30623 - protein, 10 aa, Artificial Sequence
  Description of Artificial Sequence: Synthetic peptide
  Seed: RLLEFYLAMP (CTG1B_HUMAN)
RTLEFYLAMA

SEQ ID NO: 30624 - protein, 11 aa, Artificial Sequence
  Description of Artificial Sequence: Synthetic peptide
  Seed: SLLMWITQCFL (CTG1B_HUMAN)
SSLMWITQCFV

SEQ ID NO: 30625 - protein, 10 aa, Artificial Sequence
  Description of Artificial Sequence: Synthetic peptide
  Seed: RGPHGGAASG (CTG1B_HUMAN)
RFPHGGAASA

SEQ ID NO: 30626 - protein, 9 aa, Artificial Sequence
  Description of Artificial Sequence: Synthetic peptide
  Seed: AQDAPPLPV (CTG1B_HUMAN)
ANDAPPLPV

SEQ ID NO: 30627 - protein, 10 aa, Artificial Sequence
  Description of Artificial Sequence: Synthetic peptide
  Seed: FLPVFLAQPP (CTG1B_HUMAN)
FFPVFLAQPI

SEQ ID NO: 30628 - protein, 10 aa, Artificial Sequence
  Description of Artificial Sequence: Synthetic peptide
  Seed: FTVSGNILTI (CTG1B_HUMAN)
FAVSGNILTV

SEQ ID NO: 30629 - protein, 10 aa, Artificial Sequence
  Description of Artificial Sequence: Synthetic peptide
  Seed: LSISSCLQQL (CTG1B_HUMAN)
LSISSCLQQM

SEQ ID NO: 30630 - protein, 10 aa, Artificial Sequence
  Description of Artificial Sequence: Synthetic peptide
  Seed: RGPHGGAASG (CTG1B_HUMAN)
RLPHGGAASA

SEQ ID NO: 30631 - protein, 9 aa, Artificial Sequence
  Description of Artificial Sequence: Synthetic peptide
  Seed: SSCLQQLSL (CTG1B_HUMAN)
SACLQQLSM

SEQ ID NO: 30632 - protein, 10 aa, Artificial Sequence
  Description of Artificial Sequence: Synthetic peptide
  Seed: LAQDAPPLPV (CTG1B_HUMAN)
LMQDAPPLPI

SEQ ID NO: 30633 - protein, 11 aa, Artificial Sequence
  Description of Artificial Sequence: Synthetic peptide
  Seed: FYLAMPFATPM (CTG1B_HUMAN)
FMLAMPFATPL

SEQ ID NO: 30634 - protein, 10 aa, Artificial Sequence
  Description of Artificial Sequence: Synthetic peptide
  Seed: YLAMPFATPM (CTG1B_HUMAN)
YIAMPFATPA

SEQ ID NO: 30635 - protein, 9 aa, Artificial Sequence
  Description of Artificial Sequence: Synthetic peptide
  Seed: RLLEFYLAM (CTG1B_HUMAN)
RILEFYLAF

SEQ ID NO: 30636 - protein, 10 aa, Artificial Sequence
  Description of Artificial Sequence: Synthetic peptide
  Seed: ASGPGGGAPR (CTG1B_HUMAN)
AGGPGGGAPY

SEQ ID NO: 30637 - protein, 10 aa, Artificial Sequence
  Description of Artificial Sequence: Synthetic peptide
  Seed: ASGPGGGAPR (CTG1B_HUMAN)
AIGPGGGAPY

SEQ ID NO: 30638 - protein, 10 aa, Artificial Sequence
  Description of Artificial Sequence: Synthetic peptide
  Seed: RGPESRLLEF (CTG1B_HUMAN)
RSPESRLLEF

SEQ ID NO: 30639 - protein, 9 aa, Artificial Sequence
  Description of Artificial Sequence: Synthetic peptide
  Seed: SGPGGGAPR (CTG1B_HUMAN)
SGPGGGAPM

SEQ ID NO: 30640 - protein, 10 aa, Artificial Sequence
  Description of Artificial Sequence: Synthetic peptide
  Seed: AMPFATPMEA (CTG1B_HUMAN)
AFPFATPMEF

SEQ ID NO: 30641 - protein, 9 aa, Artificial Sequence
  Description of Artificial Sequence: Synthetic peptide
  Seed: SISSCLQQL (CTG1B_HUMAN)
SMSSCLQQF

SEQ ID NO: 30642 - protein, 10 aa, Artificial Sequence
  Description of Artificial Sequence: Synthetic peptide
  Seed: FLPVFLAQPP (CTG1B_HUMAN)
FLPVFLAQPV

SEQ ID NO: 30643 - protein, 10 aa, Artificial Sequence
  Description of Artificial Sequence: Synthetic peptide
  Seed: APRGPHGGAA (CTG1B_HUMAN)
AIRGPHGGAL

SEQ ID NO: 30644 - protein, 9 aa, Artificial Sequence
  Description of Artificial Sequence: Synthetic peptide
  Seed: YLAMPFATP (CTG1B_HUMAN)
YLAMPFATA

SEQ ID NO: 30645 - protein, 9 aa, Artificial Sequence
  Description of Artificial Sequence: Synthetic peptide
  Seed: TVSGNILTI (CTG1B_HUMAN)
TLSGNILTR

SEQ ID NO: 30646 - protein, 8 aa, Artificial Sequence
  Description of Artificial Sequence: Synthetic peptide
  Seed: LPVPGVLL (CTG1B_HUMAN)
LAVPGVLL

SEQ ID NO: 30647 - protein, 11 aa, Artificial Sequence
  Description of Artificial Sequence: Synthetic peptide
  Seed: SLLMWITQCFL (CTG1B_HUMAN)
SKLMWITQCFV

SEQ ID NO: 30648 - protein, 9 aa, Artificial Sequence
  Description of Artificial Sequence: Synthetic peptide
  Seed: FYLAMPFAT (CTG1B_HUMAN)
FFLAMPFAF

SEQ ID NO: 30649 - protein, 10 aa, Artificial Sequence
  Description of Artificial Sequence: Synthetic peptide
  Seed: RLTAADHRQL (CTG1B_HUMAN)
RATAADHRQW

SEQ ID NO: 30650 - protein, 10 aa, Artificial Sequence
  Description of Artificial Sequence: Synthetic peptide
  Seed: SRLLEFYLAM (CTG1B_HUMAN)
SELLEFYLAL

SEQ ID NO: 30651 - protein, 9 aa, Artificial Sequence
  Description of Artificial Sequence: Synthetic peptide
  Seed: FLPVFLAQP (CTG1B_HUMAN)
FSPVFLAQV

SEQ ID NO: 30652 - protein, 10 aa, Artificial Sequence
  Description of Artificial Sequence: Synthetic peptide
  Seed: MPFATPMEAE (CTG1B_HUMAN)
MMFATPMEAM

SEQ ID NO: 30653 - protein, 10 aa, Artificial Sequence
  Description of Artificial Sequence: Synthetic peptide
  Seed: FYLAMPFATP (CTG1B_HUMAN)
FFLAMPFATT

SEQ ID NO: 30654 - protein, 10 aa, Artificial Sequence
  Description of Artificial Sequence: Synthetic peptide
  Seed: RSLAQDAPPL (CTG1B_HUMAN)
RVLAQDAPPV

SEQ ID NO: 30655 - protein, 10 aa, Artificial Sequence
  Description of Artificial Sequence: Synthetic peptide
  Seed: YLAMPFATPM (CTG1B_HUMAN)
YSAMPFATPA

SEQ ID NO: 30656 - protein, 11 aa, Artificial Sequence
  Description of Artificial Sequence: Synthetic peptide
  Seed: RQLQLSISSCL (CTG1B_HUMAN)
RYLQLSISSCF

SEQ ID NO: 30657 - protein, 9 aa, Artificial Sequence
  Description of Artificial Sequence: Synthetic peptide
  Seed: LAMPFATPM (CTG1B_HUMAN)
LVMPFATPW

SEQ ID NO: 30658 - protein, 9 aa, Artificial Sequence
  Description of Artificial Sequence: Synthetic peptide
  Seed: LLMWITQCF (CTG1B_HUMAN)
LMMWITQCV

SEQ ID NO: 30659 - protein, 9 aa, Artificial Sequence
  Description of Artificial Sequence: Synthetic peptide
  Seed: AADHRQLQL (CTG1B_HUMAN)
ASDHRQLQV

SEQ ID NO: 30660 - protein, 9 aa, Artificial Sequence
  Description of Artificial Sequence: Synthetic peptide
  Seed: LMWITQCFL (CTG1B_HUMAN)
LKWITQCFF

SEQ ID NO: 30661 - protein, 11 aa, Artificial Sequence
  Description of Artificial Sequence: Synthetic peptide
  Seed: GDADGPGGPGI (CTG1B_HUMAN)
GEADGPGGPGF

SEQ ID NO: 30662 - protein, 9 aa, Artificial Sequence
  Description of Artificial Sequence: Synthetic peptide
  Seed: SGNILTIRL (CTG1B_HUMAN)
SSNILTIRV

SEQ ID NO: 30663 - protein, 10 aa, Artificial Sequence
  Description of Artificial Sequence: Synthetic peptide
  Seed: ASGPGGGAPR (CTG1B_HUMAN)
AAGPGGGAPF

SEQ ID NO: 30664 - protein, 9 aa, Artificial Sequence
  Description of Artificial Sequence: Synthetic peptide
  Seed: LAMPFATPM (CTG1B_HUMAN)
LNMPFATPW

SEQ ID NO: 30665 - protein, 10 aa, Artificial Sequence
  Description of Artificial Sequence: Synthetic peptide
  Seed: LLEFYLAMPF (CTG1B_HUMAN)
LMEFYLAMPW

SEQ ID NO: 30666 - protein, 9 aa, Artificial Sequence
  Description of Artificial Sequence: Synthetic peptide
  Seed: MPFATPMEA (CTG1B_HUMAN)
MNFATPMEF

SEQ ID NO: 30667 - protein, 9 aa, Artificial Sequence
  Description of Artificial Sequence: Synthetic peptide
  Seed: QDAPPLPVP (CTG1B_HUMAN)
QEAPPLPVM

SEQ ID NO: 30668 - protein, 10 aa, Artificial Sequence
  Description of Artificial Sequence: Synthetic peptide
  Seed: APPLPVPGVL (CTG1B_HUMAN)
AGPLPVPGVL

SEQ ID NO: 30669 - protein, 10 aa, Artificial Sequence
  Description of Artificial Sequence: Synthetic peptide
  Seed: GAPRGPHGGA (CTG1B_HUMAN)
GEPRGPHGGL

SEQ ID NO: 30670 - protein, 10 aa, Artificial Sequence
  Description of Artificial Sequence: Synthetic peptide
  Seed: SRLLEFYLAM (CTG1B_HUMAN)
SLLLEFYLAF

SEQ ID NO: 30671 - protein, 10 aa, Artificial Sequence
  Description of Artificial Sequence: Synthetic peptide
  Seed: YLAMPFATPM (CTG1B_HUMAN)
YQAMPFATPV

SEQ ID NO: 30672 - protein, 9 aa, Artificial Sequence
  Description of Artificial Sequence: Synthetic peptide
  Seed: SGPGGGAPR (CTG1B_HUMAN)
SIPGGGAPY

SEQ ID NO: 30673 - protein, 9 aa, Artificial Sequence
  Description of Artificial Sequence: Synthetic peptide
  Seed: MPFATPMEA (CTG1B_HUMAN)
MPFATPMEH

SEQ ID NO: 30674 - protein, 11 aa, Artificial Sequence
  Description of Artificial Sequence: Synthetic peptide
  Seed: FYLAMPFATPM (CTG1B_HUMAN)
FFLAMPFATPA

SEQ ID NO: 30675 - protein, 11 aa, Artificial Sequence
  Description of Artificial Sequence: Synthetic peptide
  Seed: GAPRGPHGGAA (CTG1B_HUMAN)
GSPRGPHGGAV

SEQ ID NO: 30676 - protein, 11 aa, Artificial Sequence
  Description of Artificial Sequence: Synthetic peptide
  Seed: FYLAMPFATPM (CTG1B_HUMAN)
FGLAMPFATPF

SEQ ID NO: 30677 - protein, 10 aa, Artificial Sequence
  Description of Artificial Sequence: Synthetic peptide
  Seed: GAPRGPHGGA (CTG1B_HUMAN)
GRPRGPHGGM

SEQ ID NO: 30678 - protein, 10 aa, Artificial Sequence
  Description of Artificial Sequence: Synthetic peptide
  Seed: EFTVSGNILT (CTG1B_HUMAN)
EMTVSGNILV

SEQ ID NO: 30679 - protein, 9 aa, Artificial Sequence
  Description of Artificial Sequence: Synthetic peptide
  Seed: TVSGNILTI (CTG1B_HUMAN)
TMSGNILTR

SEQ ID NO: 30680 - protein, 10 aa, Artificial Sequence
  Description of Artificial Sequence: Synthetic peptide
  Seed: FYLAMPFATP (CTG1B_HUMAN)
FCLAMPFATT

SEQ ID NO: 30681 - protein, 11 aa, Artificial Sequence
  Description of Artificial Sequence: Synthetic peptide
  Seed: RQLQLSISSCL (CTG1B_HUMAN)
RVLQLSISSCF

SEQ ID NO: 30682 - protein, 9 aa, Artificial Sequence
  Description of Artificial Sequence: Synthetic peptide
  Seed: ILTIRLTAA (CTG1B_HUMAN)
IPTIRLTAL

SEQ ID NO: 30683 - protein, 11 aa, Artificial Sequence
  Description of Artificial Sequence: Synthetic peptide
  Seed: RLLEFYLAMPF (CTG1B_HUMAN)
RSLEFYLAMPM

SEQ ID NO: 30684 - protein, 9 aa, Artificial Sequence
  Description of Artificial Sequence: Synthetic peptide
  Seed: TAADHRQLQ (CTG1B_HUMAN)
TTADHRQLF

SEQ ID NO: 30685 - protein, 10 aa, Artificial Sequence
  Description of Artificial Sequence: Synthetic peptide
  Seed: SRLLEFYLAM (CTG1B_HUMAN)
SGLLEFYLAI

SEQ ID NO: 30686 - protein, 9 aa, Artificial Sequence
  Description of Artificial Sequence: Synthetic peptide
  Seed: MPFATPMEA (CTG1B_HUMAN)
MQFATPMEL

SEQ ID NO: 30687 - protein, 10 aa, Artificial Sequence
  Description of Artificial Sequence: Synthetic peptide
  Seed: LLMWITQCFL (CTG1B_HUMAN)
LSMWITQCFV

SEQ ID NO: 30688 - protein, 10 aa, Artificial Sequence
  Description of Artificial Sequence: Synthetic peptide
  Seed: TPMEAELARR (CTG1B_HUMAN)
TAMEAELARK

SEQ ID NO: 30689 - protein, 10 aa, Artificial Sequence
  Description of Artificial Sequence: Synthetic peptide
  Seed: LMWITQCFLP (CTG1B_HUMAN)
LMWITQCFLI

SEQ ID NO: 30690 - protein, 9 aa, Artificial Sequence
  Description of Artificial Sequence: Synthetic peptide
  Seed: AELARRSLA (CTG1B_HUMAN)
AELARRSLL

SEQ ID NO: 30691 - protein, 9 aa, Artificial Sequence
  Description of Artificial Sequence: Synthetic peptide
  Seed: MEAELARRS (CTG1B_HUMAN)
MEAELARRI

SEQ ID NO: 30692 - protein, 9 aa, Artificial Sequence
  Description of Artificial Sequence: Synthetic peptide
  Seed: LAMPFATPM (CTG1B_HUMAN)
LLMPFATPL

SEQ ID NO: 30693 - protein, 10 aa, Artificial Sequence
  Description of Artificial Sequence: Synthetic peptide
  Seed: RLLEFYLAMP (CTG1B_HUMAN)
RQLEFYLAMI

SEQ ID NO: 30694 - protein, 10 aa, Artificial Sequence
  Description of Artificial Sequence: Synthetic peptide
  Seed: AMPFATPMEA (CTG1B_HUMAN)
AYPFATPMEA

SEQ ID NO: 30695 - protein, 11 aa, Artificial Sequence
  Description of Artificial Sequence: Synthetic peptide
  Seed: FYLAMPFATPM (CTG1B_HUMAN)
FWLAMPFATPY

SEQ ID NO: 30696 - protein, 9 aa, Artificial Sequence
  Description of Artificial Sequence: Synthetic peptide
  Seed: FATPMEAEL (CTG1B_HUMAN)
FMTPMEAEI

SEQ ID NO: 30697 - protein, 10 aa, Artificial Sequence
  Description of Artificial Sequence: Synthetic peptide
  Seed: EFTVSGNILT (CTG1B_HUMAN)
EATVSGNILV

SEQ ID NO: 30698 - protein, 9 aa, Artificial Sequence
  Description of Artificial Sequence: Synthetic peptide
  Seed: MPFATPMEA (CTG1B_HUMAN)
MPFATPMEQ

SEQ ID NO: 30699 - protein, 11 aa, Artificial Sequence
  Description of Artificial Sequence: Synthetic peptide
  Seed: FYLAMPFATPM (CTG1B_HUMAN)
FVLAMPFATPF

SEQ ID NO: 30700 - protein, 9 aa, Artificial Sequence
  Description of Artificial Sequence: Synthetic peptide
  Seed: MPFATPMEA (CTG1B_HUMAN)
MTFATPMEY

SEQ ID NO: 30701 - protein, 9 aa, Artificial Sequence
  Description of Artificial Sequence: Synthetic peptide
  Seed: LPVFLAQPP (CTG1B_HUMAN)
LPVFLAQPY

SEQ ID NO: 30702 - protein, 10 aa, Artificial Sequence
  Description of Artificial Sequence: Synthetic peptide
  Seed: MWITQCFLPV (CTG1B_HUMAN)
MYITQCFLPI

SEQ ID NO: 30703 - protein, 8 aa, Artificial Sequence
  Description of Artificial Sequence: Synthetic peptide
  Seed: RLLEFYLA (CTG1B_HUMAN)
RLLEFYLL

SEQ ID NO: 30704 - protein, 11 aa, Artificial Sequence
  Description of Artificial Sequence: Synthetic peptide
  Seed: GAPRGPHGGAA (CTG1B_HUMAN)
GQPRGPHGGAL

SEQ ID NO: 30705 - protein, 11 aa, Artificial Sequence
  Description of Artificial Sequence: Synthetic peptide
  Seed: RQLQLSISSCL (CTG1B_HUMAN)
RPLQLSISSCF

SEQ ID NO: 30706 - protein, 11 aa, Artificial Sequence
  Description of Artificial Sequence: Synthetic peptide
  Seed: EAGATGGRGPR (CTG1B_HUMAN)
ETGATGGRGPR

SEQ ID NO: 30707 - protein, 10 aa, Artificial Sequence
  Description of Artificial Sequence: Synthetic peptide
  Seed: FYLAMPFATP (CTG1B_HUMAN)
FLLAMPFATT

SEQ ID NO: 30708 - protein, 9 aa, Artificial Sequence
  Description of Artificial Sequence: Synthetic peptide
  Seed: AQDAPPLPV (CTG1B_HUMAN)
AGDAPPLPM

SEQ ID NO: 30709 - protein, 9 aa, Artificial Sequence
  Description of Artificial Sequence: Synthetic peptide
  Seed: AADHRQLQL (CTG1B_HUMAN)
AFDHRQLQL

SEQ ID NO: 30710 - protein, 11 aa, Artificial Sequence
  Description of Artificial Sequence: Synthetic peptide
  Seed: FYLAMPFATPM (CTG1B_HUMAN)
FMLAMPFATPA

SEQ ID NO: 30711 - protein, 10 aa, Artificial Sequence
  Description of Artificial Sequence: Synthetic peptide
  Seed: RGPHGGAASG (CTG1B_HUMAN)
RPPHGGAASF

SEQ ID NO: 30712 - protein, 10 aa, Artificial Sequence
  Description of Artificial Sequence: Synthetic peptide
  Seed: FLPVFLAQPP (CTG1B_HUMAN)
FTPVFLAQPV

SEQ ID NO: 30713 - protein, 9 aa, Artificial Sequence
  Description of Artificial Sequence: Synthetic peptide
  Seed: QDAPPLPVP (CTG1B_HUMAN)
QEAPPLPVG

SEQ ID NO: 30714 - protein, 11 aa, Artificial Sequence
  Description of Artificial Sequence: Synthetic peptide
  Seed: FYLAMPFATPM (CTG1B_HUMAN)
FSLAMPFATPV

SEQ ID NO: 30715 - protein, 9 aa, Artificial Sequence
  Description of Artificial Sequence: Synthetic peptide
  Seed: LMWITQCFL (CTG1B_HUMAN)
LLWITQCFM

SEQ ID NO: 30716 - protein, 9 aa, Artificial Sequence
  Description of Artificial Sequence: Synthetic peptide
  Seed: LLMWITQCF (CTG1B_HUMAN)
LVMWITQCV

SEQ ID NO: 30717 - protein, 10 aa, Artificial Sequence
  Description of Artificial Sequence: Synthetic peptide
  Seed: MPFATPMEAE (CTG1B_HUMAN)
MAFATPMEAA

SEQ ID NO: 30718 - protein, 9 aa, Artificial Sequence
  Description of Artificial Sequence: Synthetic peptide
  Seed: FYLAMPFAT (CTG1B_HUMAN)
FMLAMPFAM

SEQ ID NO: 30719 - protein, 9 aa, Artificial Sequence
  Description of Artificial Sequence: Synthetic peptide
  Seed: FLPVFLAQP (CTG1B_HUMAN)
FTPVFLAQI

SEQ ID NO: 30720 - protein, 9 aa, Artificial Sequence
  Description of Artificial Sequence: Synthetic peptide
  Seed: AQDAPPLPV (CTG1B_HUMAN)
AYDAPPLPM

SEQ ID NO: 30721 - protein, 11 aa, Artificial Sequence
  Description of Artificial Sequence: Synthetic peptide
  Seed: RLLEFYLAMPF (CTG1B_HUMAN)
RWLEFYLAMPV

SEQ ID NO: 30722 - protein, 10 aa, Artificial Sequence
  Description of Artificial Sequence: Synthetic peptide
  Seed: FTVSGNILTI (CTG1B_HUMAN)
FLVSGNILTI

SEQ ID NO: 30723 - protein, 10 aa, Artificial Sequence
  Description of Artificial Sequence: Synthetic peptide
  Seed: YLAMPFATPM (CTG1B_HUMAN)
YTAMPFATPM

SEQ ID NO: 30724 - protein, 9 aa, Artificial Sequence
  Description of Artificial Sequence: Synthetic peptide
  Seed: LQLSISSCL (CTG1B_HUMAN)
LRLSISSCF

SEQ ID NO: 30725 - protein, 10 aa, Artificial Sequence
  Description of Artificial Sequence: Synthetic peptide
  Seed: SRLLEFYLAM (CTG1B_HUMAN)
SMLLEFYLAL

SEQ ID NO: 30726 - protein, 9 aa, Artificial Sequence
  Description of Artificial Sequence: Synthetic peptide
  Seed: RLLEFYLAM (CTG1B_HUMAN)
RSLEFYLAW

SEQ ID NO: 30727 - protein, 9 aa, Artificial Sequence
  Description of Artificial Sequence: Synthetic peptide
  Seed: AADHRQLQL (CTG1B_HUMAN)
AQDHRQLQL

SEQ ID NO: 30728 - protein, 10 aa, Artificial Sequence
  Description of Artificial Sequence: Synthetic peptide
  Seed: MPFATPMEAE (CTG1B_HUMAN)
MPFATPMEAF

SEQ ID NO: 30729 - protein, 10 aa, Artificial Sequence
  Description of Artificial Sequence: Synthetic peptide
  Seed: FLPVFLAQPP (CTG1B_HUMAN)
FSPVFLAQPI

SEQ ID NO: 30730 - protein, 9 aa, Artificial Sequence
  Description of Artificial Sequence: Synthetic peptide
  Seed: AADHRQLQL (CTG1B_HUMAN)
ANDHRQLQL

SEQ ID NO: 30731 - protein, 10 aa, Artificial Sequence
  Description of Artificial Sequence: Synthetic peptide
  Seed: SLLMWITQCF (CTG1B_HUMAN)
SVLMWITQCY

SEQ ID NO: 30732 - protein, 10 aa, Artificial Sequence
  Description of Artificial Sequence: Synthetic peptide
  Seed: FTVSGNILTI (CTG1B_HUMAN)
FLVSGNILTM

SEQ ID NO: 30733 - protein, 9 aa, Artificial Sequence
  Description of Artificial Sequence: Synthetic peptide
  Seed: FATPMEAEL (CTG1B_HUMAN)
FPTPMEAEY

SEQ ID NO: 30734 - protein, 9 aa, Artificial Sequence
  Description of Artificial Sequence: Synthetic peptide
  Seed: GVLLKEFTV (CTG1B_HUMAN)
GQLLKEFTV

SEQ ID NO: 30735 - protein, 9 aa, Artificial Sequence
  Description of Artificial Sequence: Synthetic peptide
  Seed: RLLEFYLAM (CTG1B_HUMAN)
RNLEFYLAY

SEQ ID NO: 30736 - protein, 10 aa, Artificial Sequence
  Description of Artificial Sequence: Synthetic peptide
  Seed: LLMWITQCFL (CTG1B_HUMAN)
LQMWITQCFA

SEQ ID NO: 30737 - protein, 10 aa, Artificial Sequence
  Description of Artificial Sequence: Synthetic peptide
  Seed: YLAMPFATPM (CTG1B_HUMAN)
YTAMPFATPY

SEQ ID NO: 30738 - protein, 10 aa, Artificial Sequence
  Description of Artificial Sequence: Synthetic peptide
  Seed: GAPRGPHGGA (CTG1B_HUMAN)
GKPRGPHGGM

SEQ ID NO: 30739 - protein, 10 aa, Artificial Sequence
  Description of Artificial Sequence: Synthetic peptide
  Seed: LMWITQCFLP (CTG1B_HUMAN)
LIWITQCFLV

SEQ ID NO: 30740 - protein, 9 aa, Artificial Sequence
  Description of Artificial Sequence: Synthetic peptide
  Seed: LQQLSLLMW (CTG1B_HUMAN)
LTQLSLLMW

SEQ ID NO: 30741 - protein, 10 aa, Artificial Sequence
  Description of Artificial Sequence: Synthetic peptide
  Seed: SLLMWITQCF (CTG1B_HUMAN)
SYLMWITQCY

SEQ ID NO: 30742 - protein, 9 aa, Artificial Sequence
  Description of Artificial Sequence: Synthetic peptide
  Seed: FATPMEAEL (CTG1B_HUMAN)
FITPMEAEA

SEQ ID NO: 30743 - protein, 11 aa, Artificial Sequence
  Description of Artificial Sequence: Synthetic peptide
  Seed: RASGPGGGAPR (CTG1B_HUMAN)
RSSGPGGGAPK

SEQ ID NO: 30744 - protein, 9 aa, Artificial Sequence
  Description of Artificial Sequence: Synthetic peptide
  Seed: SISSCLQQL (CTG1B_HUMAN)
SVSSCLQQI

SEQ ID NO: 30745 - protein, 10 aa, Artificial Sequence
  Description of Artificial Sequence: Synthetic peptide
  Seed: YLAMPFATPM (CTG1B_HUMAN)
YGAMPFATPY

SEQ ID NO: 30746 - protein, 10 aa, Artificial Sequence
  Description of Artificial Sequence: Synthetic peptide
  Seed: GIPDGPGGNA (CTG1B_HUMAN)
GMPDGPGGNV

SEQ ID NO: 30747 - protein, 10 aa, Artificial Sequence
  Description of Artificial Sequence: Synthetic peptide
  Seed: FLPVFLAQPP (CTG1B_HUMAN)
FVPVFLAQPV

SEQ ID NO: 30748 - protein, 9 aa, Artificial Sequence
  Description of Artificial Sequence: Synthetic peptide
  Seed: TVSGNILTI (CTG1B_HUMAN)
TTSGNILTL

SEQ ID NO: 30749 - protein, 10 aa, Artificial Sequence
  Description of Artificial Sequence: Synthetic peptide
  Seed: GPESRLLEFY (CTG1B_HUMAN)
GEESRLLEFW

SEQ ID NO: 30750 - protein, 10 aa, Artificial Sequence
  Description of Artificial Sequence: Synthetic peptide
  Seed: LLEFYLAMPF (CTG1B_HUMAN)
LNEFYLAMPF

SEQ ID NO: 30751 - protein, 10 aa, Artificial Sequence
  Description of Artificial Sequence: Synthetic peptide
  Seed: TAADHRQLQL (CTG1B_HUMAN)
TPADHRQLQM

SEQ ID NO: 30752 - protein, 9 aa, Artificial Sequence
  Description of Artificial Sequence: Synthetic peptide
  Seed: TAADHRQLQ (CTG1B_HUMAN)
TAADHRQLF

SEQ ID NO: 30753 - protein, 9 aa, Artificial Sequence
  Description of Artificial Sequence: Synthetic peptide
  Seed: ILTIRLTAA (CTG1B_HUMAN)
IVTIRLTAL

SEQ ID NO: 30754 - protein, 10 aa, Artificial Sequence
  Description of Artificial Sequence: Synthetic peptide
  Seed: APPLPVPGVL (CTG1B_HUMAN)
ADPLPVPGVL

SEQ ID NO: 30755 - protein, 9 aa, Artificial Sequence
  Description of Artificial Sequence: Synthetic peptide
  Seed: AQPPSGQRR (CTG1B_HUMAN)
AVPPSGQRM

SEQ ID NO: 30756 - protein, 9 aa, Artificial Sequence
  Description of Artificial Sequence: Synthetic peptide
  Seed: LQLSISSCL (CTG1B_HUMAN)
LQLSISSCW

SEQ ID NO: 30757 - protein, 10 aa, Artificial Sequence
  Description of Artificial Sequence: Synthetic peptide
  Seed: APPLPVPGVL (CTG1B_HUMAN)
ARPLPVPGVL

SEQ ID NO: 30758 - protein, 9 aa, Artificial Sequence
  Description of Artificial Sequence: Synthetic peptide
  Seed: AADHRQLQL (CTG1B_HUMAN)
AIDHRQLQM

SEQ ID NO: 30759 - protein, 9 aa, Artificial Sequence
  Description of Artificial Sequence: Synthetic peptide
  Seed: SISSCLQQL (CTG1B_HUMAN)
SMSSCLQQA

SEQ ID NO: 30760 - protein, 10 aa, Artificial Sequence
  Description of Artificial Sequence: Synthetic peptide
  Seed: FYLAMPFATP (CTG1B_HUMAN)
FALAMPFATA

SEQ ID NO: 30761 - protein, 11 aa, Artificial Sequence
  Description of Artificial Sequence: Synthetic peptide
  Seed: RASGPGGGAPR (CTG1B_HUMAN)
RASGPGGGAPH

SEQ ID NO: 30762 - protein, 9 aa, Artificial Sequence
  Description of Artificial Sequence: Synthetic peptide
  Seed: SGPGGGAPR (CTG1B_HUMAN)
SAPGGGAPM

SEQ ID NO: 30763 - protein, 9 aa, Artificial Sequence
  Description of Artificial Sequence: Synthetic peptide
  Seed: LMWITQCFL (CTG1B_HUMAN)
LMWITQCFI

SEQ ID NO: 30764 - protein, 10 aa, Artificial Sequence
  Description of Artificial Sequence: Synthetic peptide
  Seed: LEFYLAMPFA (CTG1B_HUMAN)
LQFYLAMPFG

SEQ ID NO: 30765 - protein, 10 aa, Artificial Sequence
  Description of Artificial Sequence: Synthetic peptide
  Seed: SRLLEFYLAM (CTG1B_HUMAN)
SSLLEFYLAF

SEQ ID NO: 30766 - protein, 9 aa, Artificial Sequence
  Description of Artificial Sequence: Synthetic peptide
  Seed: AQDAPPLPV (CTG1B_HUMAN)
AFDAPPLPI

SEQ ID NO: 30767 - protein, 8 aa, Artificial Sequence
  Description of Artificial Sequence: Synthetic peptide
  Seed: FTVSGNIL (CTG1B_HUMAN)
FAVSGNIL

SEQ ID NO: 30768 - protein, 10 aa, Artificial Sequence
  Description of Artificial Sequence: Synthetic peptide
  Seed: FLPVFLAQPP (CTG1B_HUMAN)
FSPVFLAQPT

SEQ ID NO: 30769 - protein, 11 aa, Artificial Sequence
  Description of Artificial Sequence: Synthetic peptide
  Seed: RQLQLSISSCL (CTG1B_HUMAN)
RLLQLSISSCY

SEQ ID NO: 30770 - protein, 11 aa, Artificial Sequence
  Description of Artificial Sequence: Synthetic peptide
  Seed: FYLAMPFATPM (CTG1B_HUMAN)
FVLAMPFATPY

SEQ ID NO: 30771 - protein, 10 aa, Artificial Sequence
  Description of Artificial Sequence: Synthetic peptide
  Seed: RLLEFYLAMP (CTG1B_HUMAN)
RLLEFYLAMS

SEQ ID NO: 30772 - protein, 10 aa, Artificial Sequence
  Description of Artificial Sequence: Synthetic peptide
  Seed: RGPHGGAASG (CTG1B_HUMAN)
RSPHGGAASI

SEQ ID NO: 30773 - protein, 10 aa, Artificial Sequence
  Description of Artificial Sequence: Synthetic peptide
  Seed: ISSCLQQLSL (CTG1B_HUMAN)
ICSCLQQLSW

SEQ ID NO: 30774 - protein, 9 aa, Artificial Sequence
  Description of Artificial Sequence: Synthetic peptide
  Seed: TQCFLPVFL (CTG1B_HUMAN)
TMCFLPVFA

SEQ ID NO: 30775 - protein, 10 aa, Artificial Sequence
  Description of Artificial Sequence: Synthetic peptide
  Seed: RLLEFYLAMP (CTG1B_HUMAN)
RLLEFYLAMV

SEQ ID NO: 30776 - protein, 11 aa, Artificial Sequence
  Description of Artificial Sequence: Synthetic peptide
  Seed: RASGPGGGAPR (CTG1B_HUMAN)
RMSGPGGGAPF

SEQ ID NO: 30777 - protein, 9 aa, Artificial Sequence
  Description of Artificial Sequence: Synthetic peptide
  Seed: SISSCLQQL (CTG1B_HUMAN)
SSSSCLQQY

SEQ ID NO: 30778 - protein, 10 aa, Artificial Sequence
  Description of Artificial Sequence: Synthetic peptide
  Seed: GIPDGPGGNA (CTG1B_HUMAN)
GMPDGPGGNI

SEQ ID NO: 30779 - protein, 10 aa, Artificial Sequence
  Description of Artificial Sequence: Synthetic peptide
  Seed: LEFYLAMPFA (CTG1B_HUMAN)
LQFYLAMPFP

SEQ ID NO: 30780 - protein, 10 aa, Artificial Sequence
  Description of Artificial Sequence: Synthetic peptide
  Seed: YLAMPFATPM (CTG1B_HUMAN)
YPAMPFATPC

SEQ ID NO: 30781 - protein, 11 aa, Artificial Sequence
  Description of Artificial Sequence: Synthetic peptide
  Seed: YLAMPFATPME (CTG1B_HUMAN)
YCAMPFATPMV

SEQ ID NO: 30782 - protein, 10 aa, Artificial Sequence
  Description of Artificial Sequence: Synthetic peptide
  Seed: FLAQPPSGQR (CTG1B_HUMAN)
FTAQPPSGQL

SEQ ID NO: 30783 - protein, 11 aa, Artificial Sequence
  Description of Artificial Sequence: Synthetic peptide
  Seed: MPFATPMEAEL (CTG1B_HUMAN)
MPFATPMEAEY

SEQ ID NO: 30784 - protein, 10 aa, Artificial Sequence
  Description of Artificial Sequence: Synthetic peptide
  Seed: GIPDGPGGNA (CTG1B_HUMAN)
GAPDGPGGNL

SEQ ID NO: 30785 - protein, 9 aa, Artificial Sequence
  Description of Artificial Sequence: Synthetic peptide
  Seed: SISSCLQQL (CTG1B_HUMAN)
SASSCLQQL

SEQ ID NO: 30786 - protein, 9 aa, Artificial Sequence
  Description of Artificial Sequence: Synthetic peptide
  Seed: LAMPFATPM (CTG1B_HUMAN)
LEMPFATPL

SEQ ID NO: 30787 - protein, 11 aa, Artificial Sequence
  Description of Artificial Sequence: Synthetic peptide
  Seed: RLLEFYLAMPF (CTG1B_HUMAN)
RGLEFYLAMPF

SEQ ID NO: 30788 - protein, 10 aa, Artificial Sequence
  Description of Artificial Sequence: Synthetic peptide
  Seed: APRGPHGGAA (CTG1B_HUMAN)
APRGPHGGAM

SEQ ID NO: 30789 - protein, 9 aa, Artificial Sequence
  Description of Artificial Sequence: Synthetic peptide
  Seed: APRGPHGGA (CTG1B_HUMAN)
APRGPHGGI

SEQ ID NO: 30790 - protein, 9 aa, Artificial Sequence
  Description of Artificial Sequence: Synthetic peptide
  Seed: LLMWITQCF (CTG1B_HUMAN)
LVMWITQCM

SEQ ID NO: 30791 - protein, 10 aa, Artificial Sequence
  Description of Artificial Sequence: Synthetic peptide
  Seed: RGPESRLLEF (CTG1B_HUMAN)
RTPESRLLEL

SEQ ID NO: 30792 - protein, 9 aa, Artificial Sequence
  Description of Artificial Sequence: Synthetic peptide
  Seed: AARASGPGG (CTG1B_HUMAN)
AIRASGPGK

SEQ ID NO: 30793 - protein, 9 aa, Artificial Sequence
  Description of Artificial Sequence: Synthetic peptide
  Seed: SISSCLQQL (CTG1B_HUMAN)
SLSSCLQQM

SEQ ID NO: 30794 - protein, 10 aa, Artificial Sequence
  Description of Artificial Sequence: Synthetic peptide
  Seed: MPFATPMEAE (CTG1B_HUMAN)
MSFATPMEAM

SEQ ID NO: 30795 - protein, 9 aa, Artificial Sequence
  Description of Artificial Sequence: Synthetic peptide
  Seed: APPLPVPGV (CTG1B_HUMAN)
AAPLPVPGM

SEQ ID NO: 30796 - protein, 10 aa, Artificial Sequence
  Description of Artificial Sequence: Synthetic peptide
  Seed: FTVSGNILTI (CTG1B_HUMAN)
FAVSGNILTI

SEQ ID NO: 30797 - protein, 9 aa, Artificial Sequence
  Description of Artificial Sequence: Synthetic peptide
  Seed: IPDGPGGNA (CTG1B_HUMAN)
ISDGPGGNF

SEQ ID NO: 30798 - protein, 9 aa, Artificial Sequence
  Description of Artificial Sequence: Synthetic peptide
  Seed: SGPGGGAPR (CTG1B_HUMAN)
SVPGGGAPV

SEQ ID NO: 30799 - protein, 9 aa, Artificial Sequence
  Description of Artificial Sequence: Synthetic peptide
  Seed: APPLPVPGV (CTG1B_HUMAN)
AMPLPVPGL

SEQ ID NO: 30800 - protein, 9 aa, Artificial Sequence
  Description of Artificial Sequence: Synthetic peptide
  Seed: AADHRQLQL (CTG1B_HUMAN)
AVDHRQLQL

SEQ ID NO: 30801 - protein, 10 aa, Artificial Sequence
  Description of Artificial Sequence: Synthetic peptide
  Seed: RGPHGGAASG (CTG1B_HUMAN)
RAPHGGAASA

SEQ ID NO: 30802 - protein, 9 aa, Artificial Sequence
  Description of Artificial Sequence: Synthetic peptide
  Seed: LAMPFATPM (CTG1B_HUMAN)
LQMPFATPW

SEQ ID NO: 30803 - protein, 9 aa, Artificial Sequence
  Description of Artificial Sequence: Synthetic peptide
  Seed: AARASGPGG (CTG1B_HUMAN)
AIRASGPGV

SEQ ID NO: 30804 - protein, 10 aa, Artificial Sequence
  Description of Artificial Sequence: Synthetic peptide
  Seed: IPDGPGGNAG (CTG1B_HUMAN)
IPDGPGGNAM

SEQ ID NO: 30805 - protein, 10 aa, Artificial Sequence
  Description of Artificial Sequence: Synthetic peptide
  Seed: FYLAMPFATP (CTG1B_HUMAN)
FQLAMPFATL

SEQ ID NO: 30806 - protein, 9 aa, Artificial Sequence
  Description of Artificial Sequence: Synthetic peptide
  Seed: LLMWITQCF (CTG1B_HUMAN)
LWMWITQCY

SEQ ID NO: 30807 - protein, 9 aa, Artificial Sequence
  Description of Artificial Sequence: Synthetic peptide
  Seed: RQLQLSISS (CTG1B_HUMAN)
RVLQLSISM

SEQ ID NO: 30808 - protein, 9 aa, Artificial Sequence
  Description of Artificial Sequence: Synthetic peptide
  Seed: TVSGNILTI (CTG1B_HUMAN)
TVSGNILTV

SEQ ID NO: 30809 - protein, 9 aa, Artificial Sequence
  Description of Artificial Sequence: Synthetic peptide
  Seed: ADGPGGPGI (CTG1B_HUMAN)
AEGPGGPGV

SEQ ID NO: 30810 - protein, 9 aa, Artificial Sequence
  Description of Artificial Sequence: Synthetic peptide
  Seed: SCLQQLSLL (CTG1B_HUMAN)
SALQQLSLL

SEQ ID NO: 30811 - protein, 9 aa, Artificial Sequence
  Description of Artificial Sequence: Synthetic peptide
  Seed: AARASGPGG (CTG1B_HUMAN)
AVRASGPGL

SEQ ID NO: 30812 - protein, 10 aa, Artificial Sequence
  Description of Artificial Sequence: Synthetic peptide
  Seed: RGPHGGAASG (CTG1B_HUMAN)
RWPHGGAASL

SEQ ID NO: 30813 - protein, 10 aa, Artificial Sequence
  Description of Artificial Sequence: Synthetic peptide
  Seed: LLEFYLAMPF (CTG1B_HUMAN)
LDEFYLAMPF

SEQ ID NO: 30814 - protein, 9 aa, Artificial Sequence
  Description of Artificial Sequence: Synthetic peptide
  Seed: RQLQLSISS (CTG1B_HUMAN)
RQLQLSISM

SEQ ID NO: 30815 - protein, 9 aa, Artificial Sequence
  Description of Artificial Sequence: Synthetic peptide
  Seed: SSCLQQLSL (CTG1B_HUMAN)
SICLQQLSF

SEQ ID NO: 30816 - protein, 10 aa, Artificial Sequence
  Description of Artificial Sequence: Synthetic peptide
  Seed: ITQCFLPVFL (CTG1B_HUMAN)
IIQCFLPVFV

SEQ ID NO: 30817 - protein, 9 aa, Artificial Sequence
  Description of Artificial Sequence: Synthetic peptide
  Seed: LAMPFATPM (CTG1B_HUMAN)
LRMPFATPM

SEQ ID NO: 30818 - protein, 8 aa, Artificial Sequence
  Description of Artificial Sequence: Synthetic peptide
  Seed: YLAMPFAT (CTG1B_HUMAN)
YIAMPFAV

SEQ ID NO: 30819 - protein, 10 aa, Artificial Sequence
  Description of Artificial Sequence: Synthetic peptide
  Seed: RGPHGGAASG (CTG1B_HUMAN)
RHPHGGAASL

SEQ ID NO: 30820 - protein, 10 aa, Artificial Sequence
  Description of Artificial Sequence: Synthetic peptide
  Seed: SRLLEFYLAM (CTG1B_HUMAN)
SYLLEFYLAL

SEQ ID NO: 30821 - protein, 9 aa, Artificial Sequence
  Description of Artificial Sequence: Synthetic peptide
  Seed: SLLMWITQC (CTG1B_HUMAN)
SQLMWITQV

SEQ ID NO: 30822 - protein, 10 aa, Artificial Sequence
  Description of Artificial Sequence: Synthetic peptide
  Seed: SRLLEFYLAM (CTG1B_HUMAN)
SHLLEFYLAA

SEQ ID NO: 30823 - protein, 9 aa, Artificial Sequence
  Description of Artificial Sequence: Synthetic peptide
  Seed: SGPGGGAPR (CTG1B_HUMAN)
STPGGGAPL

SEQ ID NO: 30824 - protein, 9 aa, Artificial Sequence
  Description of Artificial Sequence: Synthetic peptide
  Seed: RLLEFYLAM (CTG1B_HUMAN)
RKLEFYLAY

SEQ ID NO: 30825 - protein, 10 aa, Artificial Sequence
  Description of Artificial Sequence: Synthetic peptide
  Seed: LLMWITQCFL (CTG1B_HUMAN)
LEMWITQCFV

SEQ ID NO: 30826 - protein, 9 aa, Artificial Sequence
  Description of Artificial Sequence: Synthetic peptide
  Seed: MQAEGRGTG (CTG1B_HUMAN)
MRAEGRGTF

SEQ ID NO: 30827 - protein, 10 aa, Artificial Sequence
  Description of Artificial Sequence: Synthetic peptide
  Seed: LLEFYLAMPF (CTG1B_HUMAN)
LNEFYLAMPL

SEQ ID NO: 30828 - protein, 10 aa, Artificial Sequence
  Description of Artificial Sequence: Synthetic peptide
  Seed: YLAMPFATPM (CTG1B_HUMAN)
YWAMPFATPL

SEQ ID NO: 30829 - protein, 9 aa, Artificial Sequence
  Description of Artificial Sequence: Synthetic peptide
  Seed: TPMEAELAR (CTG1B_HUMAN)
TLMEAELAR

SEQ ID NO: 30830 - protein, 9 aa, Artificial Sequence
  Description of Artificial Sequence: Synthetic peptide
  Seed: SLLMWITQC (CTG1B_HUMAN)
SMLMWITQA

SEQ ID NO: 30831 - protein, 10 aa, Artificial Sequence
  Description of Artificial Sequence: Synthetic peptide
  Seed: LLMWITQCFL (CTG1B_HUMAN)
LMMWITQCFI

SEQ ID NO: 30832 - protein, 10 aa, Artificial Sequence
  Description of Artificial Sequence: Synthetic peptide
  Seed: YLAMPFATPM (CTG1B_HUMAN)
YPAMPFATPY

SEQ ID NO: 30833 - protein, 10 aa, Artificial Sequence
  Description of Artificial Sequence: Synthetic peptide
  Seed: SRLLEFYLAM (CTG1B_HUMAN)
SRLLEFYLAF

SEQ ID NO: 30834 - protein, 10 aa, Artificial Sequence
  Description of Artificial Sequence: Synthetic peptide
  Seed: RGPRGAGAAR (CTG1B_HUMAN)
RYPRGAGAAR

SEQ ID NO: 30835 - protein, 10 aa, Artificial Sequence
  Description of Artificial Sequence: Synthetic peptide
  Seed: LLEFYLAMPF (CTG1B_HUMAN)
LGEFYLAMPW

SEQ ID NO: 30836 - protein, 10 aa, Artificial Sequence
  Description of Artificial Sequence: Synthetic peptide
  Seed: YLAMPFATPM (CTG1B_HUMAN)
YKAMPFATPA

SEQ ID NO: 30837 - protein, 11 aa, Artificial Sequence
  Description of Artificial Sequence: Synthetic peptide
  Seed: ADGPGGPGIPD (CTG1B_HUMAN)
ARGPGGPGIPK

SEQ ID NO: 30838 - protein, 9 aa, Artificial Sequence
  Description of Artificial Sequence: Synthetic peptide
  Seed: AADHRQLQL (CTG1B_HUMAN)
AADHRQLQM

SEQ ID NO: 30839 - protein, 10 aa, Artificial Sequence
  Description of Artificial Sequence: Synthetic peptide
  Seed: GIPDGPGGNA (CTG1B_HUMAN)
GIPDGPGGNF

SEQ ID NO: 30840 - protein, 10 aa, Artificial Sequence
  Description of Artificial Sequence: Synthetic peptide
  Seed: LSISSCLQQL (CTG1B_HUMAN)
LMISSCLQQI

SEQ ID NO: 30841 - protein, 10 aa, Artificial Sequence
  Description of Artificial Sequence: Synthetic peptide
  Seed: RLLEFYLAMP (CTG1B_HUMAN)
RGLEFYLAMV

SEQ ID NO: 30842 - protein, 11 aa, Artificial Sequence
  Description of Artificial Sequence: Synthetic peptide
  Seed: APRGPHGGAAS (CTG1B_HUMAN)
AARGPHGGAAL

SEQ ID NO: 30843 - protein, 10 aa, Artificial Sequence
  Description of Artificial Sequence: Synthetic peptide
  Seed: YLAMPFATPM (CTG1B_HUMAN)
YQAMPFATPA

SEQ ID NO: 30844 - protein, 9 aa, Artificial Sequence
  Description of Artificial Sequence: Synthetic peptide
  Seed: TPMEAELAR (CTG1B_HUMAN)
TMMEAELAK

SEQ ID NO: 30845 - protein, 9 aa, Artificial Sequence
  Description of Artificial Sequence: Synthetic peptide
  Seed: LLMWITQCF (CTG1B_HUMAN)
LPMWITQCW

SEQ ID NO: 30846 - protein, 9 aa, Artificial Sequence
  Description of Artificial Sequence: Synthetic peptide
  Seed: ITQCFLPVF (CTG1B_HUMAN)
IWQCFLPVL

SEQ ID NO: 30847 - protein, 11 aa, Artificial Sequence
  Description of Artificial Sequence: Synthetic peptide
  Seed: AARASGPGGGA (CTG1B_HUMAN)
ATRASGPGGGF

SEQ ID NO: 30848 - protein, 9 aa, Artificial Sequence
  Description of Artificial Sequence: Synthetic peptide
  Seed: FATPMEAEL (CTG1B_HUMAN)
FYTPMEAEL

SEQ ID NO: 30849 - protein, 9 aa, Artificial Sequence
  Description of Artificial Sequence: Synthetic peptide
  Seed: AARASGPGG (CTG1B_HUMAN)
ATRASGPGF

SEQ ID NO: 30850 - protein, 10 aa, Artificial Sequence
  Description of Artificial Sequence: Synthetic peptide
  Seed: YLAMPFATPM (CTG1B_HUMAN)
YSAMPFATPL

SEQ ID NO: 30851 - protein, 9 aa, Artificial Sequence
  Description of Artificial Sequence: Synthetic peptide
  Seed: MPFATPMEA (CTG1B_HUMAN)
MRFATPMEV

SEQ ID NO: 30852 - protein, 11 aa, Artificial Sequence
  Description of Artificial Sequence: Synthetic peptide
  Seed: YLAMPFATPME (CTG1B_HUMAN)
YKAMPFATPMV

SEQ ID NO: 30853 - protein, 10 aa, Artificial Sequence
  Description of Artificial Sequence: Synthetic peptide
  Seed: RSLAQDAPPL (CTG1B_HUMAN)
RDLAQDAPPV

SEQ ID NO: 30854 - protein, 11 aa, Artificial Sequence
  Description of Artificial Sequence: Synthetic peptide
  Seed: RLLEFYLAMPF (CTG1B_HUMAN)
RILEFYLAMPF

SEQ ID NO: 30855 - protein, 9 aa, Artificial Sequence
  Description of Artificial Sequence: Synthetic peptide
  Seed: RLLEFYLAM (CTG1B_HUMAN)
RYLEFYLAL

SEQ ID NO: 30856 - protein, 10 aa, Artificial Sequence
  Description of Artificial Sequence: Synthetic peptide
  Seed: MPFATPMEAE (CTG1B_HUMAN)
MVFATPMEAY

SEQ ID NO: 30857 - protein, 9 aa, Artificial Sequence
  Description of Artificial Sequence: Synthetic peptide
  Seed: RQLQLSISS (CTG1B_HUMAN)
RELQLSISF

SEQ ID NO: 30858 - protein, 9 aa, Artificial Sequence
  Description of Artificial Sequence: Synthetic peptide
  Seed: SLAQDAPPL (CTG1B_HUMAN)
SHAQDAPPF

SEQ ID NO: 30859 - protein, 10 aa, Artificial Sequence
  Description of Artificial Sequence: Synthetic peptide
  Seed: SRLLEFYLAM (CTG1B_HUMAN)
SVLLEFYLAV

SEQ ID NO: 30860 - protein, 10 aa, Artificial Sequence
  Description of Artificial Sequence: Synthetic peptide
  Seed: LEFYLAMPFA (CTG1B_HUMAN)
LEFYLAMPFF

SEQ ID NO: 30861 - protein, 11 aa, Artificial Sequence
  Description of Artificial Sequence: Synthetic peptide
  Seed: AARASGPGGGA (CTG1B_HUMAN)
AARASGPGGGY

SEQ ID NO: 30862 - protein, 10 aa, Artificial Sequence
  Description of Artificial Sequence: Synthetic peptide
  Seed: MPFATPMEAE (CTG1B_HUMAN)
MPFATPMEAS

SEQ ID NO: 30863 - protein, 10 aa, Artificial Sequence
  Description of Artificial Sequence: Synthetic peptide
  Seed: FYLAMPFATP (CTG1B_HUMAN)
FILAMPFATI

SEQ ID NO: 30864 - protein, 11 aa, Artificial Sequence
  Description of Artificial Sequence: Synthetic peptide
  Seed: RASGPGGGAPR (CTG1B_HUMAN)
RVSGPGGGAPH

SEQ ID NO: 30865 - protein, 10 aa, Artificial Sequence
  Description of Artificial Sequence: Synthetic peptide
  Seed: LAMPFATPME (CTG1B_HUMAN)
LAMPFATPMM

SEQ ID NO: 30866 - protein, 9 aa, Artificial Sequence
  Description of Artificial Sequence: Synthetic peptide
  Seed: TPMEAELAR (CTG1B_HUMAN)
TFMEAELAR

SEQ ID NO: 30867 - protein, 9 aa, Artificial Sequence
  Description of Artificial Sequence: Synthetic peptide
  Seed: TAADHRQLQ (CTG1B_HUMAN)
TQADHRQLY

SEQ ID NO: 30868 - protein, 10 aa, Artificial Sequence
  Description of Artificial Sequence: Synthetic peptide
  Seed: RGPHGGAASG (CTG1B_HUMAN)
RCPHGGAASM

SEQ ID NO: 30869 - protein, 9 aa, Artificial Sequence
  Description of Artificial Sequence: Synthetic peptide
  Seed: LAQPPSGQR (CTG1B_HUMAN)
LIQPPSGQM

SEQ ID NO: 30870 - protein, 10 aa, Artificial Sequence
  Description of Artificial Sequence: Synthetic peptide
  Seed: ASGPGGGAPR (CTG1B_HUMAN)
ATGPGGGAPK

SEQ ID NO: 30871 - protein, 9 aa, Artificial Sequence
  Description of Artificial Sequence: Synthetic peptide
  Seed: TVSGNILTI (CTG1B_HUMAN)
TQSGNILTW

SEQ ID NO: 30872 - protein, 10 aa, Artificial Sequence
  Description of Artificial Sequence: Synthetic peptide
  Seed: RLTAADHRQL (CTG1B_HUMAN)
RHTAADHRQF

SEQ ID NO: 30873 - protein, 10 aa, Artificial Sequence
  Description of Artificial Sequence: Synthetic peptide
  Seed: YLAMPFATPM (CTG1B_HUMAN)
YPAMPFATPA

SEQ ID NO: 30874 - protein, 9 aa, Artificial Sequence
  Description of Artificial Sequence: Synthetic peptide
  Seed: FLPVFLAQP (CTG1B_HUMAN)
FQPVFLAQV

SEQ ID NO: 30875 - protein, 9 aa, Artificial Sequence
  Description of Artificial Sequence: Synthetic peptide
  Seed: MQAEGRGTG (CTG1B_HUMAN)
MTAEGRGTF

SEQ ID NO: 30876 - protein, 9 aa, Artificial Sequence
  Description of Artificial Sequence: Synthetic peptide
  Seed: YLAMPFATP (CTG1B_HUMAN)
YIAMPFATL

SEQ ID NO: 30877 - protein, 9 aa, Artificial Sequence
  Description of Artificial Sequence: Synthetic peptide
  Seed: SLAQDAPPL (CTG1B_HUMAN)
SKAQDAPPF

SEQ ID NO: 30878 - protein, 9 aa, Artificial Sequence
  Description of Artificial Sequence: Synthetic peptide
  Seed: LQQLSLLMW (CTG1B_HUMAN)
LQQLSLLMY

SEQ ID NO: 30879 - protein, 10 aa, Artificial Sequence
  Description of Artificial Sequence: Synthetic peptide
  Seed: LLMWITQCFL (CTG1B_HUMAN)
LMMWITQCFK

SEQ ID NO: 30880 - protein, 9 aa, Artificial Sequence
  Description of Artificial Sequence: Synthetic peptide
  Seed: LQLSISSCL (CTG1B_HUMAN)
LMLSISSCA

SEQ ID NO: 30881 - protein, 9 aa, Artificial Sequence
  Description of Artificial Sequence: Synthetic peptide
  Seed: SSCLQQLSL (CTG1B_HUMAN)
SECLQQLSM

SEQ ID NO: 30882 - protein, 10 aa, Artificial Sequence
  Description of Artificial Sequence: Synthetic peptide
  Seed: FYLAMPFATP (CTG1B_HUMAN)
FDLAMPFATA

SEQ ID NO: 30883 - protein, 8 aa, Artificial Sequence
  Description of Artificial Sequence: Synthetic peptide
  Seed: LQQLSLLM (CTG1B_HUMAN)
LQQLSLLY

SEQ ID NO: 30884 - protein, 10 aa, Artificial Sequence
  Description of Artificial Sequence: Synthetic peptide
  Seed: FTVSGNILTI (CTG1B_HUMAN)
FQVSGNILTV

SEQ ID NO: 30885 - protein, 9 aa, Artificial Sequence
  Description of Artificial Sequence: Synthetic peptide
  Seed: WITQCFLPV (CTG1B_HUMAN)
WMTQCFLPI

SEQ ID NO: 30886 - protein, 10 aa, Artificial Sequence
  Description of Artificial Sequence: Synthetic peptide
  Seed: YLAMPFATPM (CTG1B_HUMAN)
YQAMPFATPW

SEQ ID NO: 30887 - protein, 11 aa, Artificial Sequence
  Description of Artificial Sequence: Synthetic peptide
  Seed: RASGPGGGAPR (CTG1B_HUMAN)
RASGPGGGAPL

SEQ ID NO: 30888 - protein, 10 aa, Artificial Sequence
  Description of Artificial Sequence: Synthetic peptide
  Seed: RGPHGGAASG (CTG1B_HUMAN)
RPPHGGAASM

SEQ ID NO: 30889 - protein, 10 aa, Artificial Sequence
  Description of Artificial Sequence: Synthetic peptide
  Seed: RASGPGGGAP (CTG1B_HUMAN)
RMSGPGGGAY

SEQ ID NO: 30890 - protein, 10 aa, Artificial Sequence
  Description of Artificial Sequence: Synthetic peptide
  Seed: RGPESRLLEF (CTG1B_HUMAN)
RAPESRLLEW

SEQ ID NO: 30891 - protein, 10 aa, Artificial Sequence
  Description of Artificial Sequence: Synthetic peptide
  Seed: LQQLSLLMWI (CTG1B_HUMAN)
LLQLSLLMWL

SEQ ID NO: 30892 - protein, 11 aa, Artificial Sequence
  Description of Artificial Sequence: Synthetic peptide
  Seed: NAGGPGEAGAT (CTG1B_HUMAN)
NAGGPGEAGAY

SEQ ID NO: 30893 - protein, 11 aa, Artificial Sequence
  Description of Artificial Sequence: Synthetic peptide
  Seed: FYLAMPFATPM (CTG1B_HUMAN)
FLLAMPFATPA

SEQ ID NO: 30894 - protein, 9 aa, Artificial Sequence
  Description of Artificial Sequence: Synthetic peptide
  Seed: TVSGNILTI (CTG1B_HUMAN)
TSSGNILTY

SEQ ID NO: 30895 - protein, 9 aa, Artificial Sequence
  Description of Artificial Sequence: Synthetic peptide
  Seed: MPFATPMEA (CTG1B_HUMAN)
MAFATPMEA

SEQ ID NO: 30896 - protein, 9 aa, Artificial Sequence
  Description of Artificial Sequence: Synthetic peptide
  Seed: LAMPFATPM (CTG1B_HUMAN)
LTMPFATPF

SEQ ID NO: 30897 - protein, 10 aa, Artificial Sequence
  Description of Artificial Sequence: Synthetic peptide
  Seed: LQQLSLLMWI (CTG1B_HUMAN)
LLQLSLLMWV

SEQ ID NO: 30898 - protein, 10 aa, Artificial Sequence
  Description of Artificial Sequence: Synthetic peptide
  Seed: GAPRGPHGGA (CTG1B_HUMAN)
GHPRGPHGGL

SEQ ID NO: 30899 - protein, 10 aa, Artificial Sequence
  Description of Artificial Sequence: Synthetic peptide
  Seed: SRLLEFYLAM (CTG1B_HUMAN)
SRLLEFYLAI

SEQ ID NO: 30900 - protein, 9 aa, Artificial Sequence
  Description of Artificial Sequence: Synthetic peptide
  Seed: AADHRQLQL (CTG1B_HUMAN)
AGDHRQLQV

SEQ ID NO: 30901 - protein, 9 aa, Artificial Sequence
  Description of Artificial Sequence: Synthetic peptide
  Seed: AADHRQLQL (CTG1B_HUMAN)
AGDHRQLQI

SEQ ID NO: 30902 - protein, 10 aa, Artificial Sequence
  Description of Artificial Sequence: Synthetic peptide
  Seed: LSISSCLQQL (CTG1B_HUMAN)
LTISSCLQQV

SEQ ID NO: 30903 - protein, 11 aa, Artificial Sequence
  Description of Artificial Sequence: Synthetic peptide
  Seed: APRGPHGGAAS (CTG1B_HUMAN)
APRGPHGGAAI

SEQ ID NO: 30904 - protein, 9 aa, Artificial Sequence
  Description of Artificial Sequence: Synthetic peptide
  Seed: GVLLKEFTV (CTG1B_HUMAN)
GILLKEFTV

SEQ ID NO: 30905 - protein, 9 aa, Artificial Sequence
  Description of Artificial Sequence: Synthetic peptide
  Seed: FATPMEAEL (CTG1B_HUMAN)
FHTPMEAEM

SEQ ID NO: 30906 - protein, 11 aa, Artificial Sequence
  Description of Artificial Sequence: Synthetic peptide
  Seed: RQLQLSISSCL (CTG1B_HUMAN)
RKLQLSISSCY

SEQ ID NO: 30907 - protein, 10 aa, Artificial Sequence
  Description of Artificial Sequence: Synthetic peptide
  Seed: ISSCLQQLSL (CTG1B_HUMAN)
ISSCLQQLSW

SEQ ID NO: 30908 - protein, 9 aa, Artificial Sequence
  Description of Artificial Sequence: Synthetic peptide
  Seed: APPLPVPGV (CTG1B_HUMAN)
AGPLPVPGL

SEQ ID NO: 30909 - protein, 11 aa, Artificial Sequence
  Description of Artificial Sequence: Synthetic peptide
  Seed: RLLEFYLAMPF (CTG1B_HUMAN)
RNLEFYLAMPI

SEQ ID NO: 30910 - protein, 9 aa, Artificial Sequence
  Description of Artificial Sequence: Synthetic peptide
  Seed: FTVSGNILT (CTG1B_HUMAN)
FVVSGNILM

SEQ ID NO: 30911 - protein, 9 aa, Artificial Sequence
  Description of Artificial Sequence: Synthetic peptide
  Seed: LLMWITQCF (CTG1B_HUMAN)
LPMWITQCM

SEQ ID NO: 30912 - protein, 10 aa, Artificial Sequence
  Description of Artificial Sequence: Synthetic peptide
  Seed: RSLAQDAPPL (CTG1B_HUMAN)
RALAQDAPPF

SEQ ID NO: 30913 - protein, 9 aa, Artificial Sequence
  Description of Artificial Sequence: Synthetic peptide
  Seed: AADHRQLQL (CTG1B_HUMAN)
ATDHRQLQF

SEQ ID NO: 30914 - protein, 10 aa, Artificial Sequence
  Description of Artificial Sequence: Synthetic peptide
  Seed: MPFATPMEAE (CTG1B_HUMAN)
MPFATPMEAR

SEQ ID NO: 30915 - protein, 9 aa, Artificial Sequence
  Description of Artificial Sequence: Synthetic peptide
  Seed: LTAADHRQL (CTG1B_HUMAN)
LTAADHRQM

SEQ ID NO: 30916 - protein, 11 aa, Artificial Sequence
  Description of Artificial Sequence: Synthetic peptide
  Seed: RLLEFYLAMPF (CTG1B_HUMAN)
RFLEFYLAMPI

SEQ ID NO: 30917 - protein, 9 aa, Artificial Sequence
  Description of Artificial Sequence: Synthetic peptide
  Seed: RLLEFYLAM (CTG1B_HUMAN)
RMLEFYLAI

SEQ ID NO: 30918 - protein, 9 aa, Artificial Sequence
  Description of Artificial Sequence: Synthetic peptide
  Seed: LAMPFATPM (CTG1B_HUMAN)
LIMPFATPW

SEQ ID NO: 30919 - protein, 9 aa, Artificial Sequence
  Description of Artificial Sequence: Synthetic peptide
  Seed: MQAEGRGTG (CTG1B_HUMAN)
MVAEGRGTY

SEQ ID NO: 30920 - protein, 9 aa, Artificial Sequence
  Description of Artificial Sequence: Synthetic peptide
  Seed: RLLEFYLAM (CTG1B_HUMAN)
RHLEFYLAL

SEQ ID NO: 30921 - protein, 10 aa, Artificial Sequence
  Description of Artificial Sequence: Synthetic peptide
  Seed: RSLAQDAPPL (CTG1B_HUMAN)
RSLAQDAPPW

SEQ ID NO: 30922 - protein, 9 aa, Artificial Sequence
  Description of Artificial Sequence: Synthetic peptide
  Seed: LAMPFATPM (CTG1B_HUMAN)
LPMPFATPW

SEQ ID NO: 30923 - protein, 10 aa, Artificial Sequence
  Description of Artificial Sequence: Synthetic peptide
  Seed: FTVSGNILTI (CTG1B_HUMAN)
FMVSGNILTF

SEQ ID NO: 30924 - protein, 9 aa, Artificial Sequence
  Description of Artificial Sequence: Synthetic peptide
  Seed: IPDGPGGNA (CTG1B_HUMAN)
IGDGPGGNI

SEQ ID NO: 30925 - protein, 10 aa, Artificial Sequence
  Description of Artificial Sequence: Synthetic peptide
  Seed: LEFYLAMPFA (CTG1B_HUMAN)
LQFYLAMPFK

SEQ ID NO: 30926 - protein, 10 aa, Artificial Sequence
  Description of Artificial Sequence: Synthetic peptide
  Seed: SLAQDAPPLP (CTG1B_HUMAN)
SMAQDAPPLV

SEQ ID NO: 30927 - protein, 9 aa, Artificial Sequence
  Description of Artificial Sequence: Synthetic peptide
  Seed: TVSGNILTI (CTG1B_HUMAN)
TSSGNILTV

SEQ ID NO: 30928 - protein, 9 aa, Artificial Sequence
  Description of Artificial Sequence: Synthetic peptide
  Seed: LQQLSLLMW (CTG1B_HUMAN)
LKQLSLLMF

SEQ ID NO: 30929 - protein, 9 aa, Artificial Sequence
  Description of Artificial Sequence: Synthetic peptide
  Seed: LLMWITQCF (CTG1B_HUMAN)
LAMWITQCW

SEQ ID NO: 30930 - protein, 10 aa, Artificial Sequence
  Description of Artificial Sequence: Synthetic peptide
  Seed: SRLLEFYLAM (CTG1B_HUMAN)
SYLLEFYLAA

SEQ ID NO: 30931 - protein, 9 aa, Artificial Sequence
  Description of Artificial Sequence: Synthetic peptide
  Seed: IPDGPGGNA (CTG1B_HUMAN)
IVDGPGGNI

SEQ ID NO: 30932 - protein, 9 aa, Artificial Sequence
  Description of Artificial Sequence: Synthetic peptide
  Seed: SLAQDAPPL (CTG1B_HUMAN)
SLAQDAPPV

SEQ ID NO: 30933 - protein, 9 aa, Artificial Sequence
  Description of Artificial Sequence: Synthetic peptide
  Seed: MPFATPMEA (CTG1B_HUMAN)
MAFATPMEL

SEQ ID NO: 30934 - protein, 9 aa, Artificial Sequence
  Description of Artificial Sequence: Synthetic peptide
  Seed: FATPMEAEL (CTG1B_HUMAN)
FETPMEAEY

SEQ ID NO: 30935 - protein, 11 aa, Artificial Sequence
  Description of Artificial Sequence: Synthetic peptide
  Seed: LLKEFTVSGNI (CTG1B_HUMAN)
LLKEFTVSGNV

SEQ ID NO: 30936 - protein, 9 aa, Artificial Sequence
  Description of Artificial Sequence: Synthetic peptide
  Seed: SISSCLQQL (CTG1B_HUMAN)
SSSSCLQQV

SEQ ID NO: 30937 - protein, 10 aa, Artificial Sequence
  Description of Artificial Sequence: Synthetic peptide
  Seed: FLPVFLAQPP (CTG1B_HUMAN)
FHPVFLAQPV

SEQ ID NO: 30938 - protein, 9 aa, Artificial Sequence
  Description of Artificial Sequence: Synthetic peptide
  Seed: LAMPFATPM (CTG1B_HUMAN)
LGMPFATPM

SEQ ID NO: 30939 - protein, 10 aa, Artificial Sequence
  Description of Artificial Sequence: Synthetic peptide
  Seed: FTVSGNILTI (CTG1B_HUMAN)
FIVSGNILTM

SEQ ID NO: 30940 - protein, 10 aa, Artificial Sequence
  Description of Artificial Sequence: Synthetic peptide
  Seed: RGPESRLLEF (CTG1B_HUMAN)
RDPESRLLEL

SEQ ID NO: 30941 - protein, 9 aa, Artificial Sequence
  Description of Artificial Sequence: Synthetic peptide
  Seed: RQLQLSISS (CTG1B_HUMAN)
RTLQLSISM

SEQ ID NO: 30942 - protein, 10 aa, Artificial Sequence
  Description of Artificial Sequence: Synthetic peptide
  Seed: LLEFYLAMPF (CTG1B_HUMAN)
LKEFYLAMPL

SEQ ID NO: 30943 - protein, 9 aa, Artificial Sequence
  Description of Artificial Sequence: Synthetic peptide
  Seed: LLMWITQCF (CTG1B_HUMAN)
LLMWITQCT

SEQ ID NO: 30944 - protein, 9 aa, Artificial Sequence
  Description of Artificial Sequence: Synthetic peptide
  Seed: LEFYLAMPF (CTG1B_HUMAN)
LGFYLAMPM

SEQ ID NO: 30945 - protein, 10 aa, Artificial Sequence
  Description of Artificial Sequence: Synthetic peptide
  Seed: LLMWITQCFL (CTG1B_HUMAN)
LLMWITQCFV

SEQ ID NO: 30946 - protein, 11 aa, Artificial Sequence
  Description of Artificial Sequence: Synthetic peptide
  Seed: FYLAMPFATPM (CTG1B_HUMAN)
FMLAMPFATPI

SEQ ID NO: 30947 - protein, 10 aa, Artificial Sequence
  Description of Artificial Sequence: Synthetic peptide
  Seed: TPMEAELARR (CTG1B_HUMAN)
TVMEAELARR

SEQ ID NO: 30948 - protein, 11 aa, Artificial Sequence
  Description of Artificial Sequence: Synthetic peptide
  Seed: LTAADHRQLQL (CTG1B_HUMAN)
LSAADHRQLQF

SEQ ID NO: 30949 - protein, 11 aa, Artificial Sequence
  Description of Artificial Sequence: Synthetic peptide
  Seed: SSCLQQLSLLM (CTG1B_HUMAN)
SACLQQLSLLW

SEQ ID NO: 30950 - protein, 11 aa, Artificial Sequence
  Description of Artificial Sequence: Synthetic peptide
  Seed: LTAADHRQLQL (CTG1B_HUMAN)
LTAADHRQLQW

SEQ ID NO: 30951 - protein, 9 aa, Artificial Sequence
  Description of Artificial Sequence: Synthetic peptide
  Seed: FATPMEAEL (CTG1B_HUMAN)
FYTPMEAEM

SEQ ID NO: 30952 - protein, 10 aa, Artificial Sequence
  Description of Artificial Sequence: Synthetic peptide
  Seed: YLAMPFATPM (CTG1B_HUMAN)
YWAMPFATPV

SEQ ID NO: 30953 - protein, 9 aa, Artificial Sequence
  Description of Artificial Sequence: Synthetic peptide
  Seed: AARASGPGG (CTG1B_HUMAN)
AARASGPGV

SEQ ID NO: 30954 - protein, 9 aa, Artificial Sequence
  Description of Artificial Sequence: Synthetic peptide
  Seed: LAMPFATPM (CTG1B_HUMAN)
LTMPFATPR

SEQ ID NO: 30955 - protein, 9 aa, Artificial Sequence
  Description of Artificial Sequence: Synthetic peptide
  Seed: SGPGGGAPR (CTG1B_HUMAN)
STPGGGAPI

SEQ ID NO: 30956 - protein, 9 aa, Artificial Sequence
  Description of Artificial Sequence: Synthetic peptide
  Seed: FATPMEAEL (CTG1B_HUMAN)
FLTPMEAET

SEQ ID NO: 30957 - protein, 9 aa, Artificial Sequence
  Description of Artificial Sequence: Synthetic peptide
  Seed: WITQCFLPV (CTG1B_HUMAN)
WMTQCFLPL

SEQ ID NO: 30958 - protein, 9 aa, Artificial Sequence
  Description of Artificial Sequence: Synthetic peptide
  Seed: LAMPFATPM (CTG1B_HUMAN)
LIMPFATPF

SEQ ID NO: 30959 - protein, 11 aa, Artificial Sequence
  Description of Artificial Sequence: Synthetic peptide
  Seed: RLLEFYLAMPF (CTG1B_HUMAN)
RTLEFYLAMPL

SEQ ID NO: 30960 - protein, 9 aa, Artificial Sequence
  Description of Artificial Sequence: Synthetic peptide
  Seed: MPFATPMEA (CTG1B_HUMAN)
MVFATPMEW

SEQ ID NO: 30961 - protein, 10 aa, Artificial Sequence
  Description of Artificial Sequence: Synthetic peptide
  Seed: RGPHGGAASG (CTG1B_HUMAN)
RGPHGGAASM

SEQ ID NO: 30962 - protein, 9 aa, Artificial Sequence
  Description of Artificial Sequence: Synthetic peptide
  Seed: LLMWITQCF (CTG1B_HUMAN)
LQMWITQCL

SEQ ID NO: 30963 - protein, 10 aa, Artificial Sequence
  Description of Artificial Sequence: Synthetic peptide
  Seed: FYLAMPFATP (CTG1B_HUMAN)
FQLAMPFATV

SEQ ID NO: 30964 - protein, 9 aa, Artificial Sequence
  Description of Artificial Sequence: Synthetic peptide
  Seed: FLPVFLAQP (CTG1B_HUMAN)
FMPVFLAQC

SEQ ID NO: 30965 - protein, 10 aa, Artificial Sequence
  Description of Artificial Sequence: Synthetic peptide
  Seed: FLPVFLAQPP (CTG1B_HUMAN)
FCPVFLAQPT

SEQ ID NO: 30966 - protein, 9 aa, Artificial Sequence
  Description of Artificial Sequence: Synthetic peptide
  Seed: AADHRQLQL (CTG1B_HUMAN)
ATDHRQLQI

SEQ ID NO: 30967 - protein, 10 aa, Artificial Sequence
  Description of Artificial Sequence: Synthetic peptide
  Seed: LQQLSLLMWI (CTG1B_HUMAN)
LNQLSLLMWV

SEQ ID NO: 30968 - protein, 10 aa, Artificial Sequence
  Description of Artificial Sequence: Synthetic peptide
  Seed: RSLAQDAPPL (CTG1B_HUMAN)
RTLAQDAPPM

SEQ ID NO: 30969 - protein, 9 aa, Artificial Sequence
  Description of Artificial Sequence: Synthetic peptide
  Seed: ITQCFLPVF (CTG1B_HUMAN)
ISQCFLPVF

SEQ ID NO: 30970 - protein, 11 aa, Artificial Sequence
  Description of Artificial Sequence: Synthetic peptide
  Seed: FLAQPPSGQRR (CTG1B_HUMAN)
FTAQPPSGQRK

SEQ ID NO: 30971 - protein, 9 aa, Artificial Sequence
  Description of Artificial Sequence: Synthetic peptide
  Seed: LTAADHRQL (CTG1B_HUMAN)
LSAADHRQM

SEQ ID NO: 30972 - protein, 9 aa, Artificial Sequence
  Description of Artificial Sequence: Synthetic peptide
  Seed: LEFYLAMPF (CTG1B_HUMAN)
LEFYLAMPA

SEQ ID NO: 30973 - protein, 9 aa, Artificial Sequence
  Description of Artificial Sequence: Synthetic peptide
  Seed: LEFYLAMPF (CTG1B_HUMAN)
LVFYLAMPM

SEQ ID NO: 30974 - protein, 9 aa, Artificial Sequence
  Description of Artificial Sequence: Synthetic peptide
  Seed: LAMPFATPM (CTG1B_HUMAN)
LYMPFATPH

SEQ ID NO: 30975 - protein, 10 aa, Artificial Sequence
  Description of Artificial Sequence: Synthetic peptide
  Seed: RGPHGGAASG (CTG1B_HUMAN)
RLPHGGAASF

SEQ ID NO: 30976 - protein, 10 aa, Artificial Sequence
  Description of Artificial Sequence: Synthetic peptide
  Seed: RGPESRLLEF (CTG1B_HUMAN)
RTPESRLLEM

SEQ ID NO: 30977 - protein, 9 aa, Artificial Sequence
  Description of Artificial Sequence: Synthetic peptide
  Seed: LAMPFATPM (CTG1B_HUMAN)
LEMPFATPI

SEQ ID NO: 30978 - protein, 8 aa, Artificial Sequence
  Description of Artificial Sequence: Synthetic peptide
  Seed: LPVPGVLL (CTG1B_HUMAN)
LPVPGVLY

SEQ ID NO: 30979 - protein, 9 aa, Artificial Sequence
  Description of Artificial Sequence: Synthetic peptide
  Seed: TVSGNILTI (CTG1B_HUMAN)
TYSGNILTL

SEQ ID NO: 30980 - protein, 9 aa, Artificial Sequence
  Description of Artificial Sequence: Synthetic peptide
  Seed: LLKEFTVSG (CTG1B_HUMAN)
LQKEFTVSV

SEQ ID NO: 30981 - protein, 9 aa, Artificial Sequence
  Description of Artificial Sequence: Synthetic peptide
  Seed: AARASGPGG (CTG1B_HUMAN)
ASRASGPGV

SEQ ID NO: 30982 - protein, 9 aa, Artificial Sequence
  Description of Artificial Sequence: Synthetic peptide
  Seed: YLAMPFATP (CTG1B_HUMAN)
YAAMPFATV

SEQ ID NO: 30983 - protein, 9 aa, Artificial Sequence
  Description of Artificial Sequence: Synthetic peptide
  Seed: WITQCFLPV (CTG1B_HUMAN)
WLTQCFLPA

SEQ ID NO: 30984 - protein, 9 aa, Artificial Sequence
  Description of Artificial Sequence: Synthetic peptide
  Seed: AQDAPPLPV (CTG1B_HUMAN)
AHDAPPLPL

SEQ ID NO: 30985 - protein, 10 aa, Artificial Sequence
  Description of Artificial Sequence: Synthetic peptide
  Seed: FTVSGNILTI (CTG1B_HUMAN)
FIVSGNILTF

SEQ ID NO: 30986 - protein, 11 aa, Artificial Sequence
  Description of Artificial Sequence: Synthetic peptide
  Seed: MPFATPMEAEL (CTG1B_HUMAN)
MPFATPMEAEM

SEQ ID NO: 30987 - protein, 10 aa, Artificial Sequence
  Description of Artificial Sequence: Synthetic peptide
  Seed: RGPESRLLEF (CTG1B_HUMAN)
RDPESRLLEM

SEQ ID NO: 30988 - protein, 11 aa, Artificial Sequence
  Description of Artificial Sequence: Synthetic peptide
  Seed: LTAADHRQLQL (CTG1B_HUMAN)
LVAADHRQLQW

SEQ ID NO: 30989 - protein, 10 aa, Artificial Sequence
  Description of Artificial Sequence: Synthetic peptide
  Seed: APRGPHGGAA (CTG1B_HUMAN)
APRGPHGGAS

SEQ ID NO: 30990 - protein, 11 aa, Artificial Sequence
  Description of Artificial Sequence: Synthetic peptide
  Seed: FTVSGNILTIR (CTG1B_HUMAN)
FAVSGNILTIL

SEQ ID NO: 30991 - protein, 9 aa, Artificial Sequence
  Description of Artificial Sequence: Synthetic peptide
  Seed: ESRLLEFYL (CTG1B_HUMAN)
ESRLLEFYV

SEQ ID NO: 30992 - protein, 10 aa, Artificial Sequence
  Description of Artificial Sequence: Synthetic peptide
  Seed: FLAQPPSGQR (CTG1B_HUMAN)
FTAQPPSGQR

SEQ ID NO: 30993 - protein, 10 aa, Artificial Sequence
  Description of Artificial Sequence: Synthetic peptide
  Seed: YLAMPFATPM (CTG1B_HUMAN)
YRAMPFATPF

SEQ ID NO: 30994 - protein, 9 aa, Artificial Sequence
  Description of Artificial Sequence: Synthetic peptide
  Seed: IPDGPGGNA (CTG1B_HUMAN)
IIDGPGGNL

SEQ ID NO: 30995 - protein, 9 aa, Artificial Sequence
  Description of Artificial Sequence: Synthetic peptide
  Seed: LLMWITQCF (CTG1B_HUMAN)
LMMWITQCL

SEQ ID NO: 30996 - protein, 9 aa, Artificial Sequence
  Description of Artificial Sequence: Synthetic peptide
  Seed: APPLPVPGV (CTG1B_HUMAN)
ASPLPVPGI

SEQ ID NO: 30997 - protein, 10 aa, Artificial Sequence
  Description of Artificial Sequence: Synthetic peptide
  Seed: YLAMPFATPM (CTG1B_HUMAN)
YPAMPFATPW

SEQ ID NO: 30998 - protein, 10 aa, Artificial Sequence
  Description of Artificial Sequence: Synthetic peptide
  Seed: KEFTVSGNIL (CTG1B_HUMAN)
KEFTVSGNIY

SEQ ID NO: 30999 - protein, 9 aa, Artificial Sequence
  Description of Artificial Sequence: Synthetic peptide
  Seed: TQCFLPVFL (CTG1B_HUMAN)
TLCFLPVFL

SEQ ID NO: 31000 - protein, 9 aa, Artificial Sequence
  Description of Artificial Sequence: Synthetic peptide
  Seed: SGPGGGAPR (CTG1B_HUMAN)
SIPGGGAPF

SEQ ID NO: 31001 - protein, 10 aa, Artificial Sequence
  Description of Artificial Sequence: Synthetic peptide
  Seed: AMPFATPMEA (CTG1B_HUMAN)
AYPFATPMEM

SEQ ID NO: 31002 - protein, 9 aa, Artificial Sequence
  Description of Artificial Sequence: Synthetic peptide
  Seed: RLLEFYLAM (CTG1B_HUMAN)
RMLEFYLAK

SEQ ID NO: 31003 - protein, 9 aa, Artificial Sequence
  Description of Artificial Sequence: Synthetic peptide
  Seed: SGPGGGAPR (CTG1B_HUMAN)
SSPGGGAPF

SEQ ID NO: 31004 - protein, 10 aa, Artificial Sequence
  Description of Artificial Sequence: Synthetic peptide
  Seed: RGPHGGAASG (CTG1B_HUMAN)
RWPHGGAASI

SEQ ID NO: 31005 - protein, 10 aa, Artificial Sequence
  Description of Artificial Sequence: Synthetic peptide
  Seed: YLAMPFATPM (CTG1B_HUMAN)
YTAMPFATPR

SEQ ID NO: 31006 - protein, 10 aa, Artificial Sequence
  Description of Artificial Sequence: Synthetic peptide
  Seed: RGPHGGAASG (CTG1B_HUMAN)
RFPHGGAASF

SEQ ID NO: 31007 - protein, 10 aa, Artificial Sequence
  Description of Artificial Sequence: Synthetic peptide
  Seed: LAMPFATPME (CTG1B_HUMAN)
LSMPFATPMY

SEQ ID NO: 31008 - protein, 9 aa, Artificial Sequence
  Description of Artificial Sequence: Synthetic peptide
  Seed: LMWITQCFL (CTG1B_HUMAN)
LMWITQCFA

SEQ ID NO: 31009 - protein, 9 aa, Artificial Sequence
  Description of Artificial Sequence: Synthetic peptide
  Seed: ASGPGGGAP (CTG1B_HUMAN)
AAGPGGGAY

SEQ ID NO: 31010 - protein, 11 aa, Artificial Sequence
  Description of Artificial Sequence: Synthetic peptide
  Seed: RLLEFYLAMPF (CTG1B_HUMAN)
RYLEFYLAMPL

SEQ ID NO: 31011 - protein, 9 aa, Artificial Sequence
  Description of Artificial Sequence: Synthetic peptide
  Seed: AADHRQLQL (CTG1B_HUMAN)
AGDHRQLQM

SEQ ID NO: 31012 - protein, 10 aa, Artificial Sequence
  Description of Artificial Sequence: Synthetic peptide
  Seed: LLEFYLAMPF (CTG1B_HUMAN)
LGEFYLAMPY

SEQ ID NO: 31013 - protein, 9 aa, Artificial Sequence
  Description of Artificial Sequence: Synthetic peptide
  Seed: QQLSLLMWI (CTG1B_HUMAN)
QMLSLLMWV

SEQ ID NO: 31014 - protein, 10 aa, Artificial Sequence
  Description of Artificial Sequence: Synthetic peptide
  Seed: MPFATPMEAE (CTG1B_HUMAN)
MVFATPMEAM

SEQ ID NO: 31015 - protein, 9 aa, Artificial Sequence
  Description of Artificial Sequence: Synthetic peptide
  Seed: RLLEFYLAM (CTG1B_HUMAN)
RVLEFYLAL

SEQ ID NO: 31016 - protein, 11 aa, Artificial Sequence
  Description of Artificial Sequence: Synthetic peptide
  Seed: FYLAMPFATPM (CTG1B_HUMAN)
FGLAMPFATPV

SEQ ID NO: 31017 - protein, 9 aa, Artificial Sequence
  Description of Artificial Sequence: Synthetic peptide
  Seed: SISSCLQQL (CTG1B_HUMAN)
SMSSCLQQV

SEQ ID NO: 31018 - protein, 11 aa, Artificial Sequence
  Description of Artificial Sequence: Synthetic peptide
  Seed: RLLEFYLAMPF (CTG1B_HUMAN)
RWLEFYLAMPL

SEQ ID NO: 31019 - protein, 10 aa, Artificial Sequence
  Description of Artificial Sequence: Synthetic peptide
  Seed: LAMPFATPME (CTG1B_HUMAN)
LSMPFATPMF

SEQ ID NO: 31020 - protein, 9 aa, Artificial Sequence
  Description of Artificial Sequence: Synthetic peptide
  Seed: TVSGNILTI (CTG1B_HUMAN)
TASGNILTV

SEQ ID NO: 31021 - protein, 11 aa, Artificial Sequence
  Description of Artificial Sequence: Synthetic peptide
  Seed: FATPMEAELAR (CTG1B_HUMAN)
FATPMEAELAL

SEQ ID NO: 31022 - protein, 11 aa, Artificial Sequence
  Description of Artificial Sequence: Synthetic peptide
  Seed: GAPRGPHGGAA (CTG1B_HUMAN)
GRPRGPHGGAF

SEQ ID NO: 31023 - protein, 11 aa, Artificial Sequence
  Description of Artificial Sequence: Synthetic peptide
  Seed: MWITQCFLPVF (CTG1B_HUMAN)
MSITQCFLPVF

SEQ ID NO: 31024 - protein, 10 aa, Artificial Sequence
  Description of Artificial Sequence: Synthetic peptide
  Seed: SLLMWITQCF (CTG1B_HUMAN)
SMLMWITQCM

SEQ ID NO: 31025 - protein, 9 aa, Artificial Sequence
  Description of Artificial Sequence: Synthetic peptide
  Seed: FATPMEAEL (CTG1B_HUMAN)
FFTPMEAEY

SEQ ID NO: 31026 - protein, 9 aa, Artificial Sequence
  Description of Artificial Sequence: Synthetic peptide
  Seed: LAMPFATPM (CTG1B_HUMAN)
LYMPFATPA

SEQ ID NO: 31027 - protein, 10 aa, Artificial Sequence
  Description of Artificial Sequence: Synthetic peptide
  Seed: LQQLSLLMWI (CTG1B_HUMAN)
LWQLSLLMWV

SEQ ID NO: 31028 - protein, 9 aa, Artificial Sequence
  Description of Artificial Sequence: Synthetic peptide
  Seed: RLLEFYLAM (CTG1B_HUMAN)
RTLEFYLAY

SEQ ID NO: 31029 - protein, 9 aa, Artificial Sequence
  Description of Artificial Sequence: Synthetic peptide
  Seed: SGPGGGAPR (CTG1B_HUMAN)
SMPGGGAPF

SEQ ID NO: 31030 - protein, 10 aa, Artificial Sequence
  Description of Artificial Sequence: Synthetic peptide
  Seed: RGPESRLLEF (CTG1B_HUMAN)
RRPESRLLEL

SEQ ID NO: 31031 - protein, 9 aa, Artificial Sequence
  Description of Artificial Sequence: Synthetic peptide
  Seed: SISSCLQQL (CTG1B_HUMAN)
SLSSCLQQA

SEQ ID NO: 31032 - protein, 9 aa, Artificial Sequence
  Description of Artificial Sequence: Synthetic peptide
  Seed: SLAQDAPPL (CTG1B_HUMAN)
SMAQDAPPA

SEQ ID NO: 31033 - protein, 11 aa, Artificial Sequence
  Description of Artificial Sequence: Synthetic peptide
  Seed: LLMWITQCFLP (CTG1B_HUMAN)
LLMWITQCFLI

SEQ ID NO: 31034 - protein, 10 aa, Artificial Sequence
  Description of Artificial Sequence: Synthetic peptide
  Seed: EFTVSGNILT (CTG1B_HUMAN)
EHTVSGNILV

SEQ ID NO: 31035 - protein, 9 aa, Artificial Sequence
  Description of Artificial Sequence: Synthetic peptide
  Seed: LEFYLAMPF (CTG1B_HUMAN)
LAFYLAMPM

SEQ ID NO: 31036 - protein, 9 aa, Artificial Sequence
  Description of Artificial Sequence: Synthetic peptide
  Seed: TVSGNILTI (CTG1B_HUMAN)
TSSGNILTR

SEQ ID NO: 31037 - protein, 9 aa, Artificial Sequence
  Description of Artificial Sequence: Synthetic peptide
  Seed: SISSCLQQL (CTG1B_HUMAN)
SLSSCLQQI

SEQ ID NO: 31038 - protein, 11 aa, Artificial Sequence
  Description of Artificial Sequence: Synthetic peptide
  Seed: LLMWITQCFLP (CTG1B_HUMAN)
LLMWITQCFLV

SEQ ID NO: 31039 - protein, 9 aa, Artificial Sequence
  Description of Artificial Sequence: Synthetic peptide
  Seed: AELARRSLA (CTG1B_HUMAN)
AELARRSLM

SEQ ID NO: 31040 - protein, 11 aa, Artificial Sequence
  Description of Artificial Sequence: Synthetic peptide
  Seed: MWITQCFLPVF (CTG1B_HUMAN)
MSITQCFLPVY

SEQ ID NO: 31041 - protein, 10 aa, Artificial Sequence
  Description of Artificial Sequence: Synthetic peptide
  Seed: RGPHGGAASG (CTG1B_HUMAN)
RIPHGGAASI

SEQ ID NO: 31042 - protein, 10 aa, Artificial Sequence
  Description of Artificial Sequence: Synthetic peptide
  Seed: FYLAMPFATP (CTG1B_HUMAN)
FKLAMPFATT

SEQ ID NO: 31043 - protein, 10 aa, Artificial Sequence
  Description of Artificial Sequence: Synthetic peptide
  Seed: YLAMPFATPM (CTG1B_HUMAN)
YVAMPFATPR

SEQ ID NO: 31044 - protein, 11 aa, Artificial Sequence
  Description of Artificial Sequence: Synthetic peptide
  Seed: AARASGPGGGA (CTG1B_HUMAN)
ASRASGPGGGY

SEQ ID NO: 31045 - protein, 9 aa, Artificial Sequence
  Description of Artificial Sequence: Synthetic peptide
  Seed: RASGPGGGA (CTG1B_HUMAN)
RASGPGGGL

SEQ ID NO: 31046 - protein, 9 aa, Artificial Sequence
  Description of Artificial Sequence: Synthetic peptide
  Seed: SISSCLQQL (CTG1B_HUMAN)
SISSCLQQM

SEQ ID NO: 31047 - protein, 10 aa, Artificial Sequence
  Description of Artificial Sequence: Synthetic peptide
  Seed: SRLLEFYLAM (CTG1B_HUMAN)
SALLEFYLAI

SEQ ID NO: 31048 - protein, 9 aa, Artificial Sequence
  Description of Artificial Sequence: Synthetic peptide
  Seed: APPLPVPGV (CTG1B_HUMAN)
ATPLPVPGL

SEQ ID NO: 31049 - protein, 9 aa, Artificial Sequence
  Description of Artificial Sequence: Synthetic peptide
  Seed: RLLEFYLAM (CTG1B_HUMAN)
RILEFYLAA

SEQ ID NO: 31050 - protein, 9 aa, Artificial Sequence
  Description of Artificial Sequence: Synthetic peptide
  Seed: LLMWITQCF (CTG1B_HUMAN)
LVMWITQCI

SEQ ID NO: 31051 - protein, 10 aa, Artificial Sequence
  Description of Artificial Sequence: Synthetic peptide
  Seed: RGPHGGAASG (CTG1B_HUMAN)
RTPHGGAASF

SEQ ID NO: 31052 - protein, 10 aa, Artificial Sequence
  Description of Artificial Sequence: Synthetic peptide
  Seed: MPFATPMEAE (CTG1B_HUMAN)
MPFATPMEAP

SEQ ID NO: 31053 - protein, 9 aa, Artificial Sequence
  Description of Artificial Sequence: Synthetic peptide
  Seed: MQAEGRGTG (CTG1B_HUMAN)
MLAEGRGTY

SEQ ID NO: 31054 - protein, 10 aa, Artificial Sequence
  Description of Artificial Sequence: Synthetic peptide
  Seed: FTVSGNILTI (CTG1B_HUMAN)
FMVSGNILTT

SEQ ID NO: 31055 - protein, 10 aa, Artificial Sequence
  Description of Artificial Sequence: Synthetic peptide
  Seed: MPFATPMEAE (CTG1B_HUMAN)
MCFATPMEAY

SEQ ID NO: 31056 - protein, 10 aa, Artificial Sequence
  Description of Artificial Sequence: Synthetic peptide
  Seed: FTVSGNILTI (CTG1B_HUMAN)
FAVSGNILTL

SEQ ID NO: 31057 - protein, 10 aa, Artificial Sequence
  Description of Artificial Sequence: Synthetic peptide
  Seed: RSLAQDAPPL (CTG1B_HUMAN)
RTLAQDAPPK

SEQ ID NO: 31058 - protein, 11 aa, Artificial Sequence
  Description of Artificial Sequence: Synthetic peptide
  Seed: FYLAMPFATPM (CTG1B_HUMAN)
FRLAMPFATPM

SEQ ID NO: 31059 - protein, 10 aa, Artificial Sequence
  Description of Artificial Sequence: Synthetic peptide
  Seed: KEFTVSGNIL (CTG1B_HUMAN)
KSFTVSGNIF

SEQ ID NO: 31060 - protein, 9 aa, Artificial Sequence
  Description of Artificial Sequence: Synthetic peptide
  Seed: LPVFLAQPP (CTG1B_HUMAN)
LPVFLAQPF

SEQ ID NO: 31061 - protein, 10 aa, Artificial Sequence
  Description of Artificial Sequence: Synthetic peptide
  Seed: MEAELARRSL (CTG1B_HUMAN)
MPAELARRSA

SEQ ID NO: 31062 - protein, 10 aa, Artificial Sequence
  Description of Artificial Sequence: Synthetic peptide
  Seed: YLAMPFATPM (CTG1B_HUMAN)
YYAMPFATPW

SEQ ID NO: 31063 - protein, 9 aa, Artificial Sequence
  Description of Artificial Sequence: Synthetic peptide
  Seed: SGPGGGAPR (CTG1B_HUMAN)
SVPGGGAPY

SEQ ID NO: 31064 - protein, 10 aa, Artificial Sequence
  Description of Artificial Sequence: Synthetic peptide
  Seed: FTVSGNILTI (CTG1B_HUMAN)
FKVSGNILTV

SEQ ID NO: 31065 - protein, 10 aa, Artificial Sequence
  Description of Artificial Sequence: Synthetic peptide
  Seed: SSCLQQLSLL (CTG1B_HUMAN)
SSCLQQLSLW

SEQ ID NO: 31066 - protein, 9 aa, Artificial Sequence
  Description of Artificial Sequence: Synthetic peptide
  Seed: AADHRQLQL (CTG1B_HUMAN)
AEDHRQLQM

SEQ ID NO: 31067 - protein, 9 aa, Artificial Sequence
  Description of Artificial Sequence: Synthetic peptide
  Seed: LEFYLAMPF (CTG1B_HUMAN)
LQFYLAMPA

SEQ ID NO: 31068 - protein, 9 aa, Artificial Sequence
  Description of Artificial Sequence: Synthetic peptide
  Seed: LQLSISSCL (CTG1B_HUMAN)
LVLSISSCV

SEQ ID NO: 31069 - protein, 11 aa, Artificial Sequence
  Description of Artificial Sequence: Synthetic peptide
  Seed: FYLAMPFATPM (CTG1B_HUMAN)
FLLAMPFATPV

SEQ ID NO: 31070 - protein, 9 aa, Artificial Sequence
  Description of Artificial Sequence: Synthetic peptide
  Seed: MPFATPMEA (CTG1B_HUMAN)
MRFATPMEL

SEQ ID NO: 31071 - protein, 10 aa, Artificial Sequence
  Description of Artificial Sequence: Synthetic peptide
  Seed: WITQCFLPVF (CTG1B_HUMAN)
WKTQCFLPVY

SEQ ID NO: 31072 - protein, 10 aa, Artificial Sequence
  Description of Artificial Sequence: Synthetic peptide
  Seed: RASGPGGGAP (CTG1B_HUMAN)
RISGPGGGAF

SEQ ID NO: 31073 - protein, 10 aa, Artificial Sequence
  Description of Artificial Sequence: Synthetic peptide
  Seed: GIPDGPGGNA (CTG1B_HUMAN)
GVPDGPGGNM

SEQ ID NO: 31074 - protein, 10 aa, Artificial Sequence
  Description of Artificial Sequence: Synthetic peptide
  Seed: LQQLSLLMWI (CTG1B_HUMAN)
LMQLSLLMWL

SEQ ID NO: 31075 - protein, 9 aa, Artificial Sequence
  Description of Artificial Sequence: Synthetic peptide
  Seed: SISSCLQQL (CTG1B_HUMAN)
SMSSCLQQL

SEQ ID NO: 31076 - protein, 11 aa, Artificial Sequence
  Description of Artificial Sequence: Synthetic peptide
  Seed: FYLAMPFATPM (CTG1B_HUMAN)
FWLAMPFATPF

SEQ ID NO: 31077 - protein, 9 aa, Artificial Sequence
  Description of Artificial Sequence: Synthetic peptide
  Seed: LEFYLAMPF (CTG1B_HUMAN)
LHFYLAMPI

SEQ ID NO: 31078 - protein, 10 aa, Artificial Sequence
  Description of Artificial Sequence: Synthetic peptide
  Seed: FTVSGNILTI (CTG1B_HUMAN)
FQVSGNILTL

SEQ ID NO: 31079 - protein, 11 aa, Artificial Sequence
  Description of Artificial Sequence: Synthetic peptide
  Seed: RLLEFYLAMPF (CTG1B_HUMAN)
RTLEFYLAMPY

SEQ ID NO: 31080 - protein, 10 aa, Artificial Sequence
  Description of Artificial Sequence: Synthetic peptide
  Seed: RGPHGGAASG (CTG1B_HUMAN)
RWPHGGAASV

SEQ ID NO: 31081 - protein, 11 aa, Artificial Sequence
  Description of Artificial Sequence: Synthetic peptide
  Seed: GDADGPGGPGI (CTG1B_HUMAN)
GEADGPGGPGC

SEQ ID NO: 31082 - protein, 9 aa, Artificial Sequence
  Description of Artificial Sequence: Synthetic peptide
  Seed: LAQPPSGQR (CTG1B_HUMAN)
LSQPPSGQM

SEQ ID NO: 31083 - protein, 10 aa, Artificial Sequence
  Description of Artificial Sequence: Synthetic peptide
  Seed: FLPVFLAQPP (CTG1B_HUMAN)
FMPVFLAQPA

SEQ ID NO: 31084 - protein, 9 aa, Artificial Sequence
  Description of Artificial Sequence: Synthetic peptide
  Seed: LMWITQCFL (CTG1B_HUMAN)
LMWITQCFM

SEQ ID NO: 31085 - protein, 10 aa, Artificial Sequence
  Description of Artificial Sequence: Synthetic peptide
  Seed: LLMWITQCFL (CTG1B_HUMAN)
LLMWITQCFR

SEQ ID NO: 31086 - protein, 9 aa, Artificial Sequence
  Description of Artificial Sequence: Synthetic peptide
  Seed: ILTIRLTAA (CTG1B_HUMAN)
IMTIRLTAM

SEQ ID NO: 31087 - protein, 9 aa, Artificial Sequence
  Description of Artificial Sequence: Synthetic peptide
  Seed: RLLEFYLAM (CTG1B_HUMAN)
RSLEFYLAY

SEQ ID NO: 31088 - protein, 9 aa, Artificial Sequence
  Description of Artificial Sequence: Synthetic peptide
  Seed: SLLMWITQC (CTG1B_HUMAN)
SALMWITQI

SEQ ID NO: 31089 - protein, 9 aa, Artificial Sequence
  Description of Artificial Sequence: Synthetic peptide
  Seed: FLPVFLAQP (CTG1B_HUMAN)
FAPVFLAQL

SEQ ID NO: 31090 - protein, 9 aa, Artificial Sequence
  Description of Artificial Sequence: Synthetic peptide
  Seed: RLLEFYLAM (CTG1B_HUMAN)
RKLEFYLAL

SEQ ID NO: 31091 - protein, 9 aa, Artificial Sequence
  Description of Artificial Sequence: Synthetic peptide
  Seed: SISSCLQQL (CTG1B_HUMAN)
SISSCLQQA

SEQ ID NO: 31092 - protein, 10 aa, Artificial Sequence
  Description of Artificial Sequence: Synthetic peptide
  Seed: FYLAMPFATP (CTG1B_HUMAN)
FQLAMPFATA

SEQ ID NO: 31093 - protein, 11 aa, Artificial Sequence
  Description of Artificial Sequence: Synthetic peptide
  Seed: LAMPFATPMEA (CTG1B_HUMAN)
LDMPFATPMEA

SEQ ID NO: 31094 - protein, 9 aa, Artificial Sequence
  Description of Artificial Sequence: Synthetic peptide
  Seed: FTVSGNILT (CTG1B_HUMAN)
FAVSGNILA

SEQ ID NO: 31095 - protein, 9 aa, Artificial Sequence
  Description of Artificial Sequence: Synthetic peptide
  Seed: LEFYLAMPF (CTG1B_HUMAN)
LAFYLAMPF

SEQ ID NO: 31096 - protein, 10 aa, Artificial Sequence
  Description of Artificial Sequence: Synthetic peptide
  Seed: RGPHGGAASG (CTG1B_HUMAN)
RSPHGGAASL

SEQ ID NO: 31097 - protein, 10 aa, Artificial Sequence
  Description of Artificial Sequence: Synthetic peptide
  Seed: FLPVFLAQPP (CTG1B_HUMAN)
FDPVFLAQPI

SEQ ID NO: 31098 - protein, 9 aa, Artificial Sequence
  Description of Artificial Sequence: Synthetic peptide
  Seed: MPFATPMEA (CTG1B_HUMAN)
MMFATPMEY

SEQ ID NO: 31099 - protein, 9 aa, Artificial Sequence
  Description of Artificial Sequence: Synthetic peptide
  Seed: MPFATPMEA (CTG1B_HUMAN)
MPFATPMEY

SEQ ID NO: 31100 - protein, 10 aa, Artificial Sequence
  Description of Artificial Sequence: Synthetic peptide
  Seed: RSLAQDAPPL (CTG1B_HUMAN)
RTLAQDAPPF

SEQ ID NO: 31101 - protein, 9 aa, Artificial Sequence
  Description of Artificial Sequence: Synthetic peptide
  Seed: LAQPPSGQR (CTG1B_HUMAN)
LAQPPSGQH

SEQ ID NO: 31102 - protein, 10 aa, Artificial Sequence
  Description of Artificial Sequence: Synthetic peptide
  Seed: FLPVFLAQPP (CTG1B_HUMAN)
FYPVFLAQPA

SEQ ID NO: 31103 - protein, 10 aa, Artificial Sequence
  Description of Artificial Sequence: Synthetic peptide
  Seed: MWITQCFLPV (CTG1B_HUMAN)
MTITQCFLPV

SEQ ID NO: 31104 - protein, 10 aa, Artificial Sequence
  Description of Artificial Sequence: Synthetic peptide
  Seed: WITQCFLPVF (CTG1B_HUMAN)
WQTQCFLPVY

SEQ ID NO: 31105 - protein, 9 aa, Artificial Sequence
  Description of Artificial Sequence: Synthetic peptide
  Seed: AARASGPGG (CTG1B_HUMAN)
ATRASGPGA

SEQ ID NO: 31106 - protein, 10 aa, Artificial Sequence
  Description of Artificial Sequence: Synthetic peptide
  Seed: FLPVFLAQPP (CTG1B_HUMAN)
FYPVFLAQPV

SEQ ID NO: 31107 - protein, 11 aa, Artificial Sequence
  Description of Artificial Sequence: Synthetic peptide
  Seed: ISSCLQQLSLL (CTG1B_HUMAN)
ITSCLQQLSLW

SEQ ID NO: 31108 - protein, 11 aa, Artificial Sequence
  Description of Artificial Sequence: Synthetic peptide
  Seed: FYLAMPFATPM (CTG1B_HUMAN)
FHLAMPFATPV

SEQ ID NO: 31109 - protein, 9 aa, Artificial Sequence
  Description of Artificial Sequence: Synthetic peptide
  Seed: AQDAPPLPV (CTG1B_HUMAN)
AVDAPPLPI

SEQ ID NO: 31110 - protein, 10 aa, Artificial Sequence
  Description of Artificial Sequence: Synthetic peptide
  Seed: LLMWITQCFL (CTG1B_HUMAN)
LVMWITQCFR

SEQ ID NO: 31111 - protein, 9 aa, Artificial Sequence
  Description of Artificial Sequence: Synthetic peptide
  Seed: RASGPGGGA (CTG1B_HUMAN)
RASGPGGGF

SEQ ID NO: 31112 - protein, 10 aa, Artificial Sequence
  Description of Artificial Sequence: Synthetic peptide
  Seed: RGPHGGAASG (CTG1B_HUMAN)
RMPHGGAASM

SEQ ID NO: 31113 - protein, 10 aa, Artificial Sequence
  Description of Artificial Sequence: Synthetic peptide
  Seed: LLMWITQCFL (CTG1B_HUMAN)
LHMWITQCFV

SEQ ID NO: 31114 - protein, 9 aa, Artificial Sequence
  Description of Artificial Sequence: Synthetic peptide
  Seed: ASGPGGGAP (CTG1B_HUMAN)
ASGPGGGAM

SEQ ID NO: 31115 - protein, 9 aa, Artificial Sequence
  Description of Artificial Sequence: Synthetic peptide
  Seed: FLPVFLAQP (CTG1B_HUMAN)
FIPVFLAQL

SEQ ID NO: 31116 - protein, 10 aa, Artificial Sequence
  Description of Artificial Sequence: Synthetic peptide
  Seed: GIPDGPGGNA (CTG1B_HUMAN)
GAPDGPGGNI

SEQ ID NO: 31117 - protein, 9 aa, Artificial Sequence
  Description of Artificial Sequence: Synthetic peptide
  Seed: RLLEFYLAM (CTG1B_HUMAN)
RVLEFYLAR

SEQ ID NO: 31118 - protein, 9 aa, Artificial Sequence
  Description of Artificial Sequence: Synthetic peptide
  Seed: SLAQDAPPL (CTG1B_HUMAN)
STAQDAPPV

SEQ ID NO: 31119 - protein, 11 aa, Artificial Sequence
  Description of Artificial Sequence: Synthetic peptide
  Seed: APRGPHGGAAS (CTG1B_HUMAN)
APRGPHGGAAL

SEQ ID NO: 31120 - protein, 9 aa, Artificial Sequence
  Description of Artificial Sequence: Synthetic peptide
  Seed: LAMPFATPM (CTG1B_HUMAN)
LMMPFATPI

SEQ ID NO: 31121 - protein, 10 aa, Artificial Sequence
  Description of Artificial Sequence: Synthetic peptide
  Seed: ITQCFLPVFL (CTG1B_HUMAN)
ILQCFLPVFA

SEQ ID NO: 31122 - protein, 10 aa, Artificial Sequence
  Description of Artificial Sequence: Synthetic peptide
  Seed: FLPVFLAQPP (CTG1B_HUMAN)
FRPVFLAQPI

SEQ ID NO: 31123 - protein, 11 aa, Artificial Sequence
  Description of Artificial Sequence: Synthetic peptide
  Seed: RLLEFYLAMPF (CTG1B_HUMAN)
RRLEFYLAMPY

SEQ ID NO: 31124 - protein, 9 aa, Artificial Sequence
  Description of Artificial Sequence: Synthetic peptide
  Seed: AELARRSLA (CTG1B_HUMAN)
AELARRSLV

SEQ ID NO: 31125 - protein, 11 aa, Artificial Sequence
  Description of Artificial Sequence: Synthetic peptide
  Seed: GAPRGPHGGAA (CTG1B_HUMAN)
GSPRGPHGGAM

SEQ ID NO: 31126 - protein, 11 aa, Artificial Sequence
  Description of Artificial Sequence: Synthetic peptide
  Seed: LLEFYLAMPFA (CTG1B_HUMAN)
LMEFYLAMPFV

SEQ ID NO: 31127 - protein, 10 aa, Artificial Sequence
  Description of Artificial Sequence: Synthetic peptide
  Seed: RLTAADHRQL (CTG1B_HUMAN)
RDTAADHRQF

SEQ ID NO: 31128 - protein, 9 aa, Artificial Sequence
  Description of Artificial Sequence: Synthetic peptide
  Seed: AQDAPPLPV (CTG1B_HUMAN)
ANDAPPLPM

SEQ ID NO: 31129 - protein, 9 aa, Artificial Sequence
  Description of Artificial Sequence: Synthetic peptide
  Seed: FATPMEAEL (CTG1B_HUMAN)
FITPMEAEV

SEQ ID NO: 31130 - protein, 9 aa, Artificial Sequence
  Description of Artificial Sequence: Synthetic peptide
  Seed: GPRGAGAAR (CTG1B_HUMAN)
GPRGAGAAA

SEQ ID NO: 31131 - protein, 9 aa, Artificial Sequence
  Description of Artificial Sequence: Synthetic peptide
  Seed: SISSCLQQL (CTG1B_HUMAN)
STSSCLQQY

SEQ ID NO: 31132 - protein, 11 aa, Artificial Sequence
  Description of Artificial Sequence: Synthetic peptide
  Seed: FTVSGNILTIR (CTG1B_HUMAN)
FTVSGNILTIK

SEQ ID NO: 31133 - protein, 9 aa, Artificial Sequence
  Description of Artificial Sequence: Synthetic peptide
  Seed: SSCLQQLSL (CTG1B_HUMAN)
SVCLQQLSW

SEQ ID NO: 31134 - protein, 10 aa, Artificial Sequence
  Description of Artificial Sequence: Synthetic peptide
  Seed: APPLPVPGVL (CTG1B_HUMAN)
AKPLPVPGVL

SEQ ID NO: 31135 - protein, 9 aa, Artificial Sequence
  Description of Artificial Sequence: Synthetic peptide
  Seed: RLLEFYLAM (CTG1B_HUMAN)
RVLEFYLAY

SEQ ID NO: 31136 - protein, 10 aa, Artificial Sequence
  Description of Artificial Sequence: Synthetic peptide
  Seed: SRLLEFYLAM (CTG1B_HUMAN)
SCLLEFYLAI

SEQ ID NO: 31137 - protein, 10 aa, Artificial Sequence
  Description of Artificial Sequence: Synthetic peptide
  Seed: KEFTVSGNIL (CTG1B_HUMAN)
KEFTVSGNIC

SEQ ID NO: 31138 - protein, 10 aa, Artificial Sequence
  Description of Artificial Sequence: Synthetic peptide
  Seed: YLAMPFATPM (CTG1B_HUMAN)
YNAMPFATPF

SEQ ID NO: 31139 - protein, 11 aa, Artificial Sequence
  Description of Artificial Sequence: Synthetic peptide
  Seed: RASGPGGGAPR (CTG1B_HUMAN)
RVSGPGGGAPM

SEQ ID NO: 31140 - protein, 10 aa, Artificial Sequence
  Description of Artificial Sequence: Synthetic peptide
  Seed: FLPVFLAQPP (CTG1B_HUMAN)
FTPVFLAQPA

SEQ ID NO: 31141 - protein, 9 aa, Artificial Sequence
  Description of Artificial Sequence: Synthetic peptide
  Seed: SGPGGGAPR (CTG1B_HUMAN)
SFPGGGAPL

SEQ ID NO: 31142 - protein, 9 aa, Artificial Sequence
  Description of Artificial Sequence: Synthetic peptide
  Seed: TVSGNILTI (CTG1B_HUMAN)
TTSGNILTR

SEQ ID NO: 31143 - protein, 10 aa, Artificial Sequence
  Description of Artificial Sequence: Synthetic peptide
  Seed: FYLAMPFATP (CTG1B_HUMAN)
FLLAMPFATI

SEQ ID NO: 31144 - protein, 9 aa, Artificial Sequence
  Description of Artificial Sequence: Synthetic peptide
  Seed: TVSGNILTI (CTG1B_HUMAN)
TASGNILTI

SEQ ID NO: 31145 - protein, 9 aa, Artificial Sequence
  Description of Artificial Sequence: Synthetic peptide
  Seed: TVSGNILTI (CTG1B_HUMAN)
TTSGNILTW

SEQ ID NO: 31146 - protein, 11 aa, Artificial Sequence
  Description of Artificial Sequence: Synthetic peptide
  Seed: RLLEFYLAMPF (CTG1B_HUMAN)
RCLEFYLAMPY

SEQ ID NO: 31147 - protein, 9 aa, Artificial Sequence
  Description of Artificial Sequence: Synthetic peptide
  Seed: MQAEGRGTG (CTG1B_HUMAN)
MMAEGRGTW

SEQ ID NO: 31148 - protein, 9 aa, Artificial Sequence
  Description of Artificial Sequence: Synthetic peptide
  Seed: GPRGAGAAR (CTG1B_HUMAN)
GPRGAGAAL

SEQ ID NO: 31149 - protein, 9 aa, Artificial Sequence
  Description of Artificial Sequence: Synthetic peptide
  Seed: TVSGNILTI (CTG1B_HUMAN)
TISGNILTY

SEQ ID NO: 31150 - protein, 9 aa, Artificial Sequence
  Description of Artificial Sequence: Synthetic peptide
  Seed: LEFYLAMPF (CTG1B_HUMAN)
LHFYLAMPY

SEQ ID NO: 31151 - protein, 11 aa, Artificial Sequence
  Description of Artificial Sequence: Synthetic peptide
  Seed: FYLAMPFATPM (CTG1B_HUMAN)
FLLAMPFATPL

SEQ ID NO: 31152 - protein, 10 aa, Artificial Sequence
  Description of Artificial Sequence: Synthetic peptide
  Seed: FYLAMPFATP (CTG1B_HUMAN)
FPLAMPFATI

SEQ ID NO: 31153 - protein, 9 aa, Artificial Sequence
  Description of Artificial Sequence: Synthetic peptide
  Seed: LEFYLAMPF (CTG1B_HUMAN)
LAFYLAMPL

SEQ ID NO: 31154 - protein, 9 aa, Artificial Sequence
  Description of Artificial Sequence: Synthetic peptide
  Seed: WITQCFLPV (CTG1B_HUMAN)
WQTQCFLPI

SEQ ID NO: 31155 - protein, 10 aa, Artificial Sequence
  Description of Artificial Sequence: Synthetic peptide
  Seed: RGPESRLLEF (CTG1B_HUMAN)
RSPESRLLEL

SEQ ID NO: 31156 - protein, 11 aa, Artificial Sequence
  Description of Artificial Sequence: Synthetic peptide
  Seed: MPFATPMEAEL (CTG1B_HUMAN)
MMFATPMEAEY

SEQ ID NO: 31157 - protein, 9 aa, Artificial Sequence
  Description of Artificial Sequence: Synthetic peptide
  Seed: LAMPFATPM (CTG1B_HUMAN)
LYMPFATPV

SEQ ID NO: 31158 - protein, 9 aa, Artificial Sequence
  Description of Artificial Sequence: Synthetic peptide
  Seed: SLLMWITQC (CTG1B_HUMAN)
SLLMWITQI

SEQ ID NO: 31159 - protein, 9 aa, Artificial Sequence
  Description of Artificial Sequence: Synthetic peptide
  Seed: KEFTVSGNI (CTG1B_HUMAN)
KQFTVSGNV

SEQ ID NO: 31160 - protein, 9 aa, Artificial Sequence
  Description of Artificial Sequence: Synthetic peptide
  Seed: LLMWITQCF (CTG1B_HUMAN)
LWMWITQCW

SEQ ID NO: 31161 - protein, 9 aa, Artificial Sequence
  Description of Artificial Sequence: Synthetic peptide
  Seed: LAMPFATPM (CTG1B_HUMAN)
LYMPFATPY

SEQ ID NO: 31162 - protein, 8 aa, Artificial Sequence
  Description of Artificial Sequence: Synthetic peptide
  Seed: LPVPGVLL (CTG1B_HUMAN)
LPVPGVLA

SEQ ID NO: 31163 - protein, 9 aa, Artificial Sequence
  Description of Artificial Sequence: Synthetic peptide
  Seed: LTAADHRQL (CTG1B_HUMAN)
LQAADHRQL

SEQ ID NO: 31164 - protein, 9 aa, Artificial Sequence
  Description of Artificial Sequence: Synthetic peptide
  Seed: SLAQDAPPL (CTG1B_HUMAN)
SMAQDAPPM

SEQ ID NO: 31165 - protein, 9 aa, Artificial Sequence
  Description of Artificial Sequence: Synthetic peptide
  Seed: SISSCLQQL (CTG1B_HUMAN)
SMSSCLQQW

SEQ ID NO: 31166 - protein, 9 aa, Artificial Sequence
  Description of Artificial Sequence: Synthetic peptide
  Seed: FTVSGNILT (CTG1B_HUMAN)
FSVSGNILI

SEQ ID NO: 31167 - protein, 9 aa, Artificial Sequence
  Description of Artificial Sequence: Synthetic peptide
  Seed: SLAQDAPPL (CTG1B_HUMAN)
STAQDAPPY

SEQ ID NO: 31168 - protein, 10 aa, Artificial Sequence
  Description of Artificial Sequence: Synthetic peptide
  Seed: FLPVFLAQPP (CTG1B_HUMAN)
FKPVFLAQPA

SEQ ID NO: 31169 - protein, 10 aa, Artificial Sequence
  Description of Artificial Sequence: Synthetic peptide
  Seed: SLLMWITQCF (CTG1B_HUMAN)
SGLMWITQCY

SEQ ID NO: 31170 - protein, 9 aa, Artificial Sequence
  Description of Artificial Sequence: Synthetic peptide
  Seed: LPVPGVLLK (CTG1B_HUMAN)
LAVPGVLLI

SEQ ID NO: 31171 - protein, 11 aa, Artificial Sequence
  Description of Artificial Sequence: Synthetic peptide
  Seed: RLLEFYLAMPF (CTG1B_HUMAN)
RQLEFYLAMPL

SEQ ID NO: 31172 - protein, 9 aa, Artificial Sequence
  Description of Artificial Sequence: Synthetic peptide
  Seed: TQCFLPVFL (CTG1B_HUMAN)
TLCFLPVFI

SEQ ID NO: 31173 - protein, 11 aa, Artificial Sequence
  Description of Artificial Sequence: Synthetic peptide
  Seed: MWITQCFLPVF (CTG1B_HUMAN)
MSITQCFLPVW

SEQ ID NO: 31174 - protein, 8 aa, Artificial Sequence
  Description of Artificial Sequence: Synthetic peptide
  Seed: ISSCLQQL (CTG1B_HUMAN)
IQSCLQQV

SEQ ID NO: 31175 - protein, 10 aa, Artificial Sequence
  Description of Artificial Sequence: Synthetic peptide
  Seed: RGPESRLLEF (CTG1B_HUMAN)
RQPESRLLEL

SEQ ID NO: 31176 - protein, 9 aa, Artificial Sequence
  Description of Artificial Sequence: Synthetic peptide
  Seed: MPFATPMEA (CTG1B_HUMAN)
MIFATPMEY

SEQ ID NO: 31177 - protein, 11 aa, Artificial Sequence
  Description of Artificial Sequence: Synthetic peptide
  Seed: FYLAMPFATPM (CTG1B_HUMAN)
FWLAMPFATPV

SEQ ID NO: 31178 - protein, 11 aa, Artificial Sequence
  Description of Artificial Sequence: Synthetic peptide
  Seed: FYLAMPFATPM (CTG1B_HUMAN)
FVLAMPFATPI

SEQ ID NO: 31179 - protein, 10 aa, Artificial Sequence
  Description of Artificial Sequence: Synthetic peptide
  Seed: FYLAMPFATP (CTG1B_HUMAN)
FWLAMPFATV

SEQ ID NO: 31180 - protein, 9 aa, Artificial Sequence
  Description of Artificial Sequence: Synthetic peptide
  Seed: RQLQLSISS (CTG1B_HUMAN)
RMLQLSISI

SEQ ID NO: 31181 - protein, 9 aa, Artificial Sequence
  Description of Artificial Sequence: Synthetic peptide
  Seed: SLAQDAPPL (CTG1B_HUMAN)
STAQDAPPF

SEQ ID NO: 31182 - protein, 11 aa, Artificial Sequence
  Description of Artificial Sequence: Synthetic peptide
  Seed: RLLEFYLAMPF (CTG1B_HUMAN)
RLLEFYLAMPA

SEQ ID NO: 31183 - protein, 10 aa, Artificial Sequence
  Description of Artificial Sequence: Synthetic peptide
  Seed: MWITQCFLPV (CTG1B_HUMAN)
MYITQCFLPL

SEQ ID NO: 31184 - protein, 10 aa, Artificial Sequence
  Description of Artificial Sequence: Synthetic peptide
  Seed: RLTAADHRQL (CTG1B_HUMAN)
RQTAADHRQL

SEQ ID NO: 31185 - protein, 9 aa, Artificial Sequence
  Description of Artificial Sequence: Synthetic peptide
  Seed: AADHRQLQL (CTG1B_HUMAN)
AQDHRQLQM

SEQ ID NO: 31186 - protein, 10 aa, Artificial Sequence
  Description of Artificial Sequence: Synthetic peptide
  Seed: ASGPGGGAPR (CTG1B_HUMAN)
ASGPGGGAPY

SEQ ID NO: 31187 - protein, 9 aa, Artificial Sequence
  Description of Artificial Sequence: Synthetic peptide
  Seed: RLLEFYLAM (CTG1B_HUMAN)
RILEFYLAW

SEQ ID NO: 31188 - protein, 10 aa, Artificial Sequence
  Description of Artificial Sequence: Synthetic peptide
  Seed: TPMEAELARR (CTG1B_HUMAN)
TTMEAELARR

SEQ ID NO: 31189 - protein, 9 aa, Artificial Sequence
  Description of Artificial Sequence: Synthetic peptide
  Seed: AQPPSGQRR (CTG1B_HUMAN)
AAPPSGQRL

SEQ ID NO: 31190 - protein, 10 aa, Artificial Sequence
  Description of Artificial Sequence: Synthetic peptide
  Seed: AQDAPPLPVP (CTG1B_HUMAN)
AEDAPPLPVV

SEQ ID NO: 31191 - protein, 10 aa, Artificial Sequence
  Description of Artificial Sequence: Synthetic peptide
  Seed: FLPVFLAQPP (CTG1B_HUMAN)
FGPVFLAQPA

SEQ ID NO: 31192 - protein, 10 aa, Artificial Sequence
  Description of Artificial Sequence: Synthetic peptide
  Seed: YLAMPFATPM (CTG1B_HUMAN)
YTAMPFATPV

SEQ ID NO: 31193 - protein, 10 aa, Artificial Sequence
  Description of Artificial Sequence: Synthetic peptide
  Seed: ISSCLQQLSL (CTG1B_HUMAN)
IGSCLQQLSW

SEQ ID NO: 31194 - protein, 10 aa, Artificial Sequence
  Description of Artificial Sequence: Synthetic peptide
  Seed: FTVSGNILTI (CTG1B_HUMAN)
FTVSGNILTW

SEQ ID NO: 31195 - protein, 10 aa, Artificial Sequence
  Description of Artificial Sequence: Synthetic peptide
  Seed: AMPFATPMEA (CTG1B_HUMAN)
AFPFATPMEM

SEQ ID NO: 31196 - protein, 9 aa, Artificial Sequence
  Description of Artificial Sequence: Synthetic peptide
  Seed: ITQCFLPVF (CTG1B_HUMAN)
IYQCFLPVL

SEQ ID NO: 31197 - protein, 10 aa, Artificial Sequence
  Description of Artificial Sequence: Synthetic peptide
  Seed: LSISSCLQQL (CTG1B_HUMAN)
LMISSCLQQL

SEQ ID NO: 31198 - protein, 9 aa, Artificial Sequence
  Description of Artificial Sequence: Synthetic peptide
  Seed: LPVFLAQPP (CTG1B_HUMAN)
LPVFLAQPH

SEQ ID NO: 31199 - protein, 10 aa, Artificial Sequence
  Description of Artificial Sequence: Synthetic peptide
  Seed: RGPRGAGAAR (CTG1B_HUMAN)
RMPRGAGAAR

SEQ ID NO: 31200 - protein, 9 aa, Artificial Sequence
  Description of Artificial Sequence: Synthetic peptide
  Seed: FATPMEAEL (CTG1B_HUMAN)
FPTPMEAEV

SEQ ID NO: 31201 - protein, 10 aa, Artificial Sequence
  Description of Artificial Sequence: Synthetic peptide
  Seed: FTVSGNILTI (CTG1B_HUMAN)
FMVSGNILTC

SEQ ID NO: 31202 - protein, 10 aa, Artificial Sequence
  Description of Artificial Sequence: Synthetic peptide
  Seed: RGPHGGAASG (CTG1B_HUMAN)
RVPHGGAASI

SEQ ID NO: 31203 - protein, 9 aa, Artificial Sequence
  Description of Artificial Sequence: Synthetic peptide
  Seed: RLLEFYLAM (CTG1B_HUMAN)
RYLEFYLAV

SEQ ID NO: 31204 - protein, 9 aa, Artificial Sequence
  Description of Artificial Sequence: Synthetic peptide
  Seed: APPLPVPGV (CTG1B_HUMAN)
ATPLPVPGM

SEQ ID NO: 31205 - protein, 10 aa, Artificial Sequence
  Description of Artificial Sequence: Synthetic peptide
  Seed: CLQQLSLLMW (CTG1B_HUMAN)
CAQQLSLLMW

SEQ ID NO: 31206 - protein, 9 aa, Artificial Sequence
  Description of Artificial Sequence: Synthetic peptide
  Seed: TVSGNILTI (CTG1B_HUMAN)
TMSGNILTY

SEQ ID NO: 31207 - protein, 10 aa, Artificial Sequence
  Description of Artificial Sequence: Synthetic peptide
  Seed: EFTVSGNILT (CTG1B_HUMAN)
EHTVSGNILI

SEQ ID NO: 31208 - protein, 9 aa, Artificial Sequence
  Description of Artificial Sequence: Synthetic peptide
  Seed: LLMWITQCF (CTG1B_HUMAN)
LTMWITQCY

SEQ ID NO: 31209 - protein, 9 aa, Artificial Sequence
  Description of Artificial Sequence: Synthetic peptide
  Seed: ADGPGGPGI (CTG1B_HUMAN)
AEGPGGPGL

SEQ ID NO: 31210 - protein, 11 aa, Artificial Sequence
  Description of Artificial Sequence: Synthetic peptide
  Seed: RASGPGGGAPR (CTG1B_HUMAN)
RISGPGGGAPY

SEQ ID NO: 31211 - protein, 9 aa, Artificial Sequence
  Description of Artificial Sequence: Synthetic peptide
  Seed: LTAADHRQL (CTG1B_HUMAN)
LSAADHRQY

SEQ ID NO: 31212 - protein, 9 aa, Artificial Sequence
  Description of Artificial Sequence: Synthetic peptide
  Seed: RLLEFYLAM (CTG1B_HUMAN)
RRLEFYLAV

SEQ ID NO: 31213 - protein, 11 aa, Artificial Sequence
  Description of Artificial Sequence: Synthetic peptide
  Seed: GAPRGPHGGAA (CTG1B_HUMAN)
GRPRGPHGGAM

SEQ ID NO: 31214 - protein, 10 aa, Artificial Sequence
  Description of Artificial Sequence: Synthetic peptide
  Seed: MWITQCFLPV (CTG1B_HUMAN)
MTITQCFLPL

SEQ ID NO: 31215 - protein, 9 aa, Artificial Sequence
  Description of Artificial Sequence: Synthetic peptide
  Seed: AARASGPGG (CTG1B_HUMAN)
AFRASGPGK

SEQ ID NO: 31216 - protein, 9 aa, Artificial Sequence
  Description of Artificial Sequence: Synthetic peptide
  Seed: LPVPGVLLK (CTG1B_HUMAN)
LTVPGVLLL

SEQ ID NO: 31217 - protein, 9 aa, Artificial Sequence
  Description of Artificial Sequence: Synthetic peptide
  Seed: APRGPHGGA (CTG1B_HUMAN)
APRGPHGGL

SEQ ID NO: 31218 - protein, 11 aa, Artificial Sequence
  Description of Artificial Sequence: Synthetic peptide
  Seed: RLLEFYLAMPF (CTG1B_HUMAN)
RTLEFYLAMPI

SEQ ID NO: 31219 - protein, 9 aa, Artificial Sequence
  Description of Artificial Sequence: Synthetic peptide
  Seed: SLAQDAPPL (CTG1B_HUMAN)
SIAQDAPPY

SEQ ID NO: 31220 - protein, 10 aa, Artificial Sequence
  Description of Artificial Sequence: Synthetic peptide
  Seed: YLAMPFATPM (CTG1B_HUMAN)
YPAMPFATPM

SEQ ID NO: 31221 - protein, 10 aa, Artificial Sequence
  Description of Artificial Sequence: Synthetic peptide
  Seed: SRLLEFYLAM (CTG1B_HUMAN)
SQLLEFYLAM

SEQ ID NO: 31222 - protein, 9 aa, Artificial Sequence
  Description of Artificial Sequence: Synthetic peptide
  Seed: SSCLQQLSL (CTG1B_HUMAN)
SQCLQQLSF

SEQ ID NO: 31223 - protein, 9 aa, Artificial Sequence
  Description of Artificial Sequence: Synthetic peptide
  Seed: RLLEFYLAM (CTG1B_HUMAN)
RSLEFYLAR

SEQ ID NO: 31224 - protein, 10 aa, Artificial Sequence
  Description of Artificial Sequence: Synthetic peptide
  Seed: RGPHGGAASG (CTG1B_HUMAN)
RGPHGGAASI

SEQ ID NO: 31225 - protein, 9 aa, Artificial Sequence
  Description of Artificial Sequence: Synthetic peptide
  Seed: QQLSLLMWI (CTG1B_HUMAN)
QILSLLMWI

SEQ ID NO: 31226 - protein, 9 aa, Artificial Sequence
  Description of Artificial Sequence: Synthetic peptide
  Seed: SLLMWITQC (CTG1B_HUMAN)
SQLMWITQL

SEQ ID NO: 31227 - protein, 10 aa, Artificial Sequence
  Description of Artificial Sequence: Synthetic peptide
  Seed: FTVSGNILTI (CTG1B_HUMAN)
FQVSGNILTY

SEQ ID NO: 31228 - protein, 11 aa, Artificial Sequence
  Description of Artificial Sequence: Synthetic peptide
  Seed: FYLAMPFATPM (CTG1B_HUMAN)
FCLAMPFATPY

SEQ ID NO: 31229 - protein, 10 aa, Artificial Sequence
  Description of Artificial Sequence: Synthetic peptide
  Seed: GAPRGPHGGA (CTG1B_HUMAN)
GAPRGPHGGL

SEQ ID NO: 31230 - protein, 9 aa, Artificial Sequence
  Description of Artificial Sequence: Synthetic peptide
  Seed: TVSGNILTI (CTG1B_HUMAN)
TISGNILTF

SEQ ID NO: 31231 - protein, 10 aa, Artificial Sequence
  Description of Artificial Sequence: Synthetic peptide
  Seed: AASGLNGCCR (CTG1B_HUMAN)
AVSGLNGCCK

SEQ ID NO: 31232 - protein, 10 aa, Artificial Sequence
  Description of Artificial Sequence: Synthetic peptide
  Seed: AMPFATPMEA (CTG1B_HUMAN)
AHPFATPMEY

SEQ ID NO: 31233 - protein, 9 aa, Artificial Sequence
  Description of Artificial Sequence: Synthetic peptide
  Seed: LPVPGVLLK (CTG1B_HUMAN)
LAVPGVLLV

SEQ ID NO: 31234 - protein, 10 aa, Artificial Sequence
  Description of Artificial Sequence: Synthetic peptide
  Seed: YLAMPFATPM (CTG1B_HUMAN)
YGAMPFATPV

SEQ ID NO: 31235 - protein, 10 aa, Artificial Sequence
  Description of Artificial Sequence: Synthetic peptide
  Seed: GIPDGPGGNA (CTG1B_HUMAN)
GTPDGPGGNF

SEQ ID NO: 31236 - protein, 10 aa, Artificial Sequence
  Description of Artificial Sequence: Synthetic peptide
  Seed: SRLLEFYLAM (CTG1B_HUMAN)
SGLLEFYLAA

SEQ ID NO: 31237 - protein, 9 aa, Artificial Sequence
  Description of Artificial Sequence: Synthetic peptide
  Seed: FYLAMPFAT (CTG1B_HUMAN)
FYLAMPFAM

SEQ ID NO: 31238 - protein, 10 aa, Artificial Sequence
  Description of Artificial Sequence: Synthetic peptide
  Seed: MPFATPMEAE (CTG1B_HUMAN)
MAFATPMEAM

SEQ ID NO: 31239 - protein, 10 aa, Artificial Sequence
  Description of Artificial Sequence: Synthetic peptide
  Seed: SLLMWITQCF (CTG1B_HUMAN)
SWLMWITQCY

SEQ ID NO: 31240 - protein, 9 aa, Artificial Sequence
  Description of Artificial Sequence: Synthetic peptide
  Seed: LAQPPSGQR (CTG1B_HUMAN)
LSQPPSGQL

SEQ ID NO: 31241 - protein, 9 aa, Artificial Sequence
  Description of Artificial Sequence: Synthetic peptide
  Seed: LMWITQCFL (CTG1B_HUMAN)
LLWITQCFI

SEQ ID NO: 31242 - protein, 10 aa, Artificial Sequence
  Description of Artificial Sequence: Synthetic peptide
  Seed: TVSGNILTIR (CTG1B_HUMAN)
TSSGNILTIK

SEQ ID NO: 31243 - protein, 10 aa, Artificial Sequence
  Description of Artificial Sequence: Synthetic peptide
  Seed: GAPRGPHGGA (CTG1B_HUMAN)
GCPRGPHGGM

SEQ ID NO: 31244 - protein, 10 aa, Artificial Sequence
  Description of Artificial Sequence: Synthetic peptide
  Seed: AQDAPPLPVP (CTG1B_HUMAN)
AEDAPPLPVM

SEQ ID NO: 31245 - protein, 9 aa, Artificial Sequence
  Description of Artificial Sequence: Synthetic peptide
  Seed: LQLSISSCL (CTG1B_HUMAN)
LLLSISSCV

SEQ ID NO: 31246 - protein, 9 aa, Artificial Sequence
  Description of Artificial Sequence: Synthetic peptide
  Seed: TPMEAELAR (CTG1B_HUMAN)
TIMEAELAK

SEQ ID NO: 31247 - protein, 9 aa, Artificial Sequence
  Description of Artificial Sequence: Synthetic peptide
  Seed: QQLSLLMWI (CTG1B_HUMAN)
QQLSLLMWV

SEQ ID NO: 31248 - protein, 10 aa, Artificial Sequence
  Description of Artificial Sequence: Synthetic peptide
  Seed: EFTVSGNILT (CTG1B_HUMAN)
ENTVSGNILV

SEQ ID NO: 31249 - protein, 9 aa, Artificial Sequence
  Description of Artificial Sequence: Synthetic peptide
  Seed: TAADHRQLQ (CTG1B_HUMAN)
TSADHRQLM

SEQ ID NO: 31250 - protein, 10 aa, Artificial Sequence
  Description of Artificial Sequence: Synthetic peptide
  Seed: FLAQPPSGQR (CTG1B_HUMAN)
FAAQPPSGQM

SEQ ID NO: 31251 - protein, 10 aa, Artificial Sequence
  Description of Artificial Sequence: Synthetic peptide
  Seed: AMPFATPMEA (CTG1B_HUMAN)
AVPFATPMEY

SEQ ID NO: 31252 - protein, 9 aa, Artificial Sequence
  Description of Artificial Sequence: Synthetic peptide
  Seed: LEFYLAMPF (CTG1B_HUMAN)
LSFYLAMPF

SEQ ID NO: 31253 - protein, 9 aa, Artificial Sequence
  Description of Artificial Sequence: Synthetic peptide
  Seed: AARASGPGG (CTG1B_HUMAN)
AARASGPGK

SEQ ID NO: 31254 - protein, 10 aa, Artificial Sequence
  Description of Artificial Sequence: Synthetic peptide
  Seed: MWITQCFLPV (CTG1B_HUMAN)
MQITQCFLPL

SEQ ID NO: 31255 - protein, 10 aa, Artificial Sequence
  Description of Artificial Sequence: Synthetic peptide
  Seed: RGPHGGAASG (CTG1B_HUMAN)
RSPHGGAASA

SEQ ID NO: 31256 - protein, 9 aa, Artificial Sequence
  Description of Artificial Sequence: Synthetic peptide
  Seed: LAMPFATPM (CTG1B_HUMAN)
LTMPFATPI

SEQ ID NO: 31257 - protein, 11 aa, Artificial Sequence
  Description of Artificial Sequence: Synthetic peptide
  Seed: FYLAMPFATPM (CTG1B_HUMAN)
FSLAMPFATPM

SEQ ID NO: 31258 - protein, 11 aa, Artificial Sequence
  Description of Artificial Sequence: Synthetic peptide
  Seed: RLLEFYLAMPF (CTG1B_HUMAN)
RQLEFYLAMPY

SEQ ID NO: 31259 - protein, 10 aa, Artificial Sequence
  Description of Artificial Sequence: Synthetic peptide
  Seed: AQDAPPLPVP (CTG1B_HUMAN)
AEDAPPLPVI

SEQ ID NO: 31260 - protein, 10 aa, Artificial Sequence
  Description of Artificial Sequence: Synthetic peptide
  Seed: EFTVSGNILT (CTG1B_HUMAN)
EYTVSGNILI

SEQ ID NO: 31261 - protein, 9 aa, Artificial Sequence
  Description of Artificial Sequence: Synthetic peptide
  Seed: LAMPFATPM (CTG1B_HUMAN)
LMMPFATPF

SEQ ID NO: 31262 - protein, 10 aa, Artificial Sequence
  Description of Artificial Sequence: Synthetic peptide
  Seed: FYLAMPFATP (CTG1B_HUMAN)
FYLAMPFATL

SEQ ID NO: 31263 - protein, 9 aa, Artificial Sequence
  Description of Artificial Sequence: Synthetic peptide
  Seed: LEFYLAMPF (CTG1B_HUMAN)
LIFYLAMPF

SEQ ID NO: 31264 - protein, 9 aa, Artificial Sequence
  Description of Artificial Sequence: Synthetic peptide
  Seed: AADHRQLQL (CTG1B_HUMAN)
AVDHRQLQM

SEQ ID NO: 31265 - protein, 10 aa, Artificial Sequence
  Description of Artificial Sequence: Synthetic peptide
  Seed: LLMWITQCFL (CTG1B_HUMAN)
LQMWITQCFI

SEQ ID NO: 31266 - protein, 9 aa, Artificial Sequence
  Description of Artificial Sequence: Synthetic peptide
  Seed: TPMEAELAR (CTG1B_HUMAN)
TPMEAELAF

SEQ ID NO: 31267 - protein, 9 aa, Artificial Sequence
  Description of Artificial Sequence: Synthetic peptide
  Seed: LLKEFTVSG (CTG1B_HUMAN)
LIKEFTVSI

SEQ ID NO: 31268 - protein, 9 aa, Artificial Sequence
  Description of Artificial Sequence: Synthetic peptide
  Seed: AQDAPPLPV (CTG1B_HUMAN)
AWDAPPLPV

SEQ ID NO: 31269 - protein, 9 aa, Artificial Sequence
  Description of Artificial Sequence: Synthetic peptide
  Seed: MPFATPMEA (CTG1B_HUMAN)
MTFATPMEA

SEQ ID NO: 31270 - protein, 10 aa, Artificial Sequence
  Description of Artificial Sequence: Synthetic peptide
  Seed: RLTAADHRQL (CTG1B_HUMAN)
RMTAADHRQF

SEQ ID NO: 31271 - protein, 11 aa, Artificial Sequence
  Description of Artificial Sequence: Synthetic peptide
  Seed: RLLEFYLAMPF (CTG1B_HUMAN)
RCLEFYLAMPL

SEQ ID NO: 31272 - protein, 10 aa, Artificial Sequence
  Description of Artificial Sequence: Synthetic peptide
  Seed: LSISSCLQQL (CTG1B_HUMAN)
LVISSCLQQL

SEQ ID NO: 31273 - protein, 10 aa, Artificial Sequence
  Description of Artificial Sequence: Synthetic peptide
  Seed: LEFYLAMPFA (CTG1B_HUMAN)
LKFYLAMPFM

SEQ ID NO: 31274 - protein, 9 aa, Artificial Sequence
  Description of Artificial Sequence: Synthetic peptide
  Seed: RLLEFYLAM (CTG1B_HUMAN)
RALEFYLAF

SEQ ID NO: 31275 - protein, 8 aa, Artificial Sequence
  Description of Artificial Sequence: Synthetic peptide
  Seed: AMPFATPM (CTG1B_HUMAN)
AQPFATPY

SEQ ID NO: 31276 - protein, 11 aa, Artificial Sequence
  Description of Artificial Sequence: Synthetic peptide
  Seed: MPFATPMEAEL (CTG1B_HUMAN)
MPFATPMEAEF

SEQ ID NO: 31277 - protein, 11 aa, Artificial Sequence
  Description of Artificial Sequence: Synthetic peptide
  Seed: FYLAMPFATPM (CTG1B_HUMAN)
FILAMPFATPV

SEQ ID NO: 31278 - protein, 10 aa, Artificial Sequence
  Description of Artificial Sequence: Synthetic peptide
  Seed: FYLAMPFATP (CTG1B_HUMAN)
FMLAMPFATV

SEQ ID NO: 31279 - protein, 9 aa, Artificial Sequence
  Description of Artificial Sequence: Synthetic peptide
  Seed: LPVFLAQPP (CTG1B_HUMAN)
LPVFLAQPT

SEQ ID NO: 31280 - protein, 10 aa, Artificial Sequence
  Description of Artificial Sequence: Synthetic peptide
  Seed: LQQLSLLMWI (CTG1B_HUMAN)
LQQLSLLMWV

SEQ ID NO: 31281 - protein, 9 aa, Artificial Sequence
  Description of Artificial Sequence: Synthetic peptide
  Seed: CLQQLSLLM (CTG1B_HUMAN)
CQQQLSLLL

SEQ ID NO: 31282 - protein, 10 aa, Artificial Sequence
  Description of Artificial Sequence: Synthetic peptide
  Seed: GAPRGPHGGA (CTG1B_HUMAN)
GVPRGPHGGM

SEQ ID NO: 31283 - protein, 11 aa, Artificial Sequence
  Description of Artificial Sequence: Synthetic peptide
  Seed: RLLEFYLAMPF (CTG1B_HUMAN)
RFLEFYLAMPM

SEQ ID NO: 31284 - protein, 10 aa, Artificial Sequence
  Description of Artificial Sequence: Synthetic peptide
  Seed: SSCLQQLSLL (CTG1B_HUMAN)
SSCLQQLSLY

SEQ ID NO: 31285 - protein, 10 aa, Artificial Sequence
  Description of Artificial Sequence: Synthetic peptide
  Seed: MPFATPMEAE (CTG1B_HUMAN)
MPFATPMEAQ

SEQ ID NO: 31286 - protein, 10 aa, Artificial Sequence
  Description of Artificial Sequence: Synthetic peptide
  Seed: RGPHGGAASG (CTG1B_HUMAN)
RMPHGGAASV

SEQ ID NO: 31287 - protein, 9 aa, Artificial Sequence
  Description of Artificial Sequence: Synthetic peptide
  Seed: AQPPSGQRR (CTG1B_HUMAN)
ATPPSGQRM

SEQ ID NO: 31288 - protein, 9 aa, Artificial Sequence
  Description of Artificial Sequence: Synthetic peptide
  Seed: LQLSISSCL (CTG1B_HUMAN)
LLLSISSCF

SEQ ID NO: 31289 - protein, 10 aa, Artificial Sequence
  Description of Artificial Sequence: Synthetic peptide
  Seed: EFTVSGNILT (CTG1B_HUMAN)
EWTVSGNILI

SEQ ID NO: 31290 - protein, 10 aa, Artificial Sequence
  Description of Artificial Sequence: Synthetic peptide
  Seed: FLPVFLAQPP (CTG1B_HUMAN)
FNPVFLAQPI

SEQ ID NO: 31291 - protein, 9 aa, Artificial Sequence
  Description of Artificial Sequence: Synthetic peptide
  Seed: AADHRQLQL (CTG1B_HUMAN)
ASDHRQLQI

SEQ ID NO: 31292 - protein, 9 aa, Artificial Sequence
  Description of Artificial Sequence: Synthetic peptide
  Seed: LPVPGVLLK (CTG1B_HUMAN)
LVVPGVLLY

SEQ ID NO: 31293 - protein, 9 aa, Artificial Sequence
  Description of Artificial Sequence: Synthetic peptide
  Seed: AADHRQLQL (CTG1B_HUMAN)
AYDHRQLQV

SEQ ID NO: 31294 - protein, 10 aa, Artificial Sequence
  Description of Artificial Sequence: Synthetic peptide
  Seed: LAQDAPPLPV (CTG1B_HUMAN)
LIQDAPPLPV

SEQ ID NO: 31295 - protein, 9 aa, Artificial Sequence
  Description of Artificial Sequence: Synthetic peptide
  Seed: RLLEFYLAM (CTG1B_HUMAN)
RILEFYLAI

SEQ ID NO: 31296 - protein, 11 aa, Artificial Sequence
  Description of Artificial Sequence: Synthetic peptide
  Seed: SLLMWITQCFL (CTG1B_HUMAN)
SMLMWITQCFA

SEQ ID NO: 31297 - protein, 10 aa, Artificial Sequence
  Description of Artificial Sequence: Synthetic peptide
  Seed: RQLQLSISSC (CTG1B_HUMAN)
RELQLSISSL

SEQ ID NO: 31298 - protein, 9 aa, Artificial Sequence
  Description of Artificial Sequence: Synthetic peptide
  Seed: TVSGNILTI (CTG1B_HUMAN)
TLSGNILTL

SEQ ID NO: 31299 - protein, 9 aa, Artificial Sequence
  Description of Artificial Sequence: Synthetic peptide
  Seed: SISSCLQQL (CTG1B_HUMAN)
SMSSCLQQR

SEQ ID NO: 31300 - protein, 10 aa, Artificial Sequence
  Description of Artificial Sequence: Synthetic peptide
  Seed: ISSCLQQLSL (CTG1B_HUMAN)
ITSCLQQLSY

SEQ ID NO: 31301 - protein, 11 aa, Artificial Sequence
  Description of Artificial Sequence: Synthetic peptide
  Seed: RASGPGGGAPR (CTG1B_HUMAN)
RVSGPGGGAPY

SEQ ID NO: 31302 - protein, 10 aa, Artificial Sequence
  Description of Artificial Sequence: Synthetic peptide
  Seed: LAQDAPPLPV (CTG1B_HUMAN)
LLQDAPPLPV

SEQ ID NO: 31303 - protein, 9 aa, Artificial Sequence
  Description of Artificial Sequence: Synthetic peptide
  Seed: CLQQLSLLM (CTG1B_HUMAN)
CLQQLSLLL

SEQ ID NO: 31304 - protein, 11 aa, Artificial Sequence
  Description of Artificial Sequence: Synthetic peptide
  Seed: AARASGPGGGA (CTG1B_HUMAN)
AARASGPGGGL

SEQ ID NO: 31305 - protein, 9 aa, Artificial Sequence
  Description of Artificial Sequence: Synthetic peptide
  Seed: MPFATPMEA (CTG1B_HUMAN)
MFFATPMEM

SEQ ID NO: 31306 - protein, 9 aa, Artificial Sequence
  Description of Artificial Sequence: Synthetic peptide
  Seed: MPFATPMEA (CTG1B_HUMAN)
MPFATPMEF

SEQ ID NO: 31307 - protein, 10 aa, Artificial Sequence
  Description of Artificial Sequence: Synthetic peptide
  Seed: YLAMPFATPM (CTG1B_HUMAN)
YRAMPFATPA

SEQ ID NO: 31308 - protein, 10 aa, Artificial Sequence
  Description of Artificial Sequence: Synthetic peptide
  Seed: SRLLEFYLAM (CTG1B_HUMAN)
SALLEFYLAV

SEQ ID NO: 31309 - protein, 9 aa, Artificial Sequence
  Description of Artificial Sequence: Synthetic peptide
  Seed: FLPVFLAQP (CTG1B_HUMAN)
FQPVFLAQI

SEQ ID NO: 31310 - protein, 10 aa, Artificial Sequence
  Description of Artificial Sequence: Synthetic peptide
  Seed: GIPDGPGGNA (CTG1B_HUMAN)
GAPDGPGGNM

SEQ ID NO: 31311 - protein, 9 aa, Artificial Sequence
  Description of Artificial Sequence: Synthetic peptide
  Seed: LEFYLAMPF (CTG1B_HUMAN)
LAFYLAMPY

SEQ ID NO: 31312 - protein, 10 aa, Artificial Sequence
  Description of Artificial Sequence: Synthetic peptide
  Seed: YLAMPFATPM (CTG1B_HUMAN)
YDAMPFATPI

SEQ ID NO: 31313 - protein, 11 aa, Artificial Sequence
  Description of Artificial Sequence: Synthetic peptide
  Seed: RLLEFYLAMPF (CTG1B_HUMAN)
RALEFYLAMPI

SEQ ID NO: 31314 - protein, 10 aa, Artificial Sequence
  Description of Artificial Sequence: Synthetic peptide
  Seed: SRLLEFYLAM (CTG1B_HUMAN)
SKLLEFYLAI

SEQ ID NO: 31315 - protein, 9 aa, Artificial Sequence
  Description of Artificial Sequence: Synthetic peptide
  Seed: TPMEAELAR (CTG1B_HUMAN)
TYMEAELAR

SEQ ID NO: 31316 - protein, 9 aa, Artificial Sequence
  Description of Artificial Sequence: Synthetic peptide
  Seed: ASGPGGGAP (CTG1B_HUMAN)
AVGPGGGAY

SEQ ID NO: 31317 - protein, 9 aa, Artificial Sequence
  Description of Artificial Sequence: Synthetic peptide
  Seed: FATPMEAEL (CTG1B_HUMAN)
FRTPMEAEY

SEQ ID NO: 31318 - protein, 10 aa, Artificial Sequence
  Description of Artificial Sequence: Synthetic peptide
  Seed: GAPRGPHGGA (CTG1B_HUMAN)
GDPRGPHGGL

SEQ ID NO: 31319 - protein, 11 aa, Artificial Sequence
  Description of Artificial Sequence: Synthetic peptide
  Seed: GEAGATGGRGP (CTG1B_HUMAN)
GEAGATGGRGV

SEQ ID NO: 31320 - protein, 9 aa, Artificial Sequence
  Description of Artificial Sequence: Synthetic peptide
  Seed: LPVFLAQPP (CTG1B_HUMAN)
LPVFLAQPA

SEQ ID NO: 31321 - protein, 9 aa, Artificial Sequence
  Description of Artificial Sequence: Synthetic peptide
  Seed: RQLQLSISS (CTG1B_HUMAN)
RQLQLSISA

SEQ ID NO: 31322 - protein, 11 aa, Artificial Sequence
  Description of Artificial Sequence: Synthetic peptide
  Seed: LLMWITQCFLP (CTG1B_HUMAN)
LMMWITQCFLI

SEQ ID NO: 31323 - protein, 9 aa, Artificial Sequence
  Description of Artificial Sequence: Synthetic peptide
  Seed: LPVFLAQPP (CTG1B_HUMAN)
LPVFLAQPM

SEQ ID NO: 31324 - protein, 9 aa, Artificial Sequence
  Description of Artificial Sequence: Synthetic peptide
  Seed: FATPMEAEL (CTG1B_HUMAN)
FVTPMEAEA

SEQ ID NO: 31325 - protein, 9 aa, Artificial Sequence
  Description of Artificial Sequence: Synthetic peptide
  Seed: TVSGNILTI (CTG1B_HUMAN)
TPSGNILTL

SEQ ID NO: 31326 - protein, 10 aa, Artificial Sequence
  Description of Artificial Sequence: Synthetic peptide
  Seed: RGPHGGAASG (CTG1B_HUMAN)
RQPHGGAASI

SEQ ID NO: 31327 - protein, 9 aa, Artificial Sequence
  Description of Artificial Sequence: Synthetic peptide
  Seed: YLAMPFATP (CTG1B_HUMAN)
YLAMPFATC

SEQ ID NO: 31328 - protein, 10 aa, Artificial Sequence
  Description of Artificial Sequence: Synthetic peptide
  Seed: YLAMPFATPM (CTG1B_HUMAN)
YYAMPFATPM

SEQ ID NO: 31329 - protein, 11 aa, Artificial Sequence
  Description of Artificial Sequence: Synthetic peptide
  Seed: RASGPGGGAPR (CTG1B_HUMAN)
RVSGPGGGAPK

SEQ ID NO: 31330 - protein, 9 aa, Artificial Sequence
  Description of Artificial Sequence: Synthetic peptide
  Seed: SSCLQQLSL (CTG1B_HUMAN)
SSCLQQLSV

SEQ ID NO: 31331 - protein, 10 aa, Artificial Sequence
  Description of Artificial Sequence: Synthetic peptide
  Seed: RGPHGGAASG (CTG1B_HUMAN)
RNPHGGAASM

SEQ ID NO: 31332 - protein, 11 aa, Artificial Sequence
  Description of Artificial Sequence: Synthetic peptide
  Seed: RLLEFYLAMPF (CTG1B_HUMAN)
RLLEFYLAMPW

SEQ ID NO: 31333 - protein, 9 aa, Artificial Sequence
  Description of Artificial Sequence: Synthetic peptide
  Seed: FATPMEAEL (CTG1B_HUMAN)
FWTPMEAEM

SEQ ID NO: 31334 - protein, 11 aa, Artificial Sequence
  Description of Artificial Sequence: Synthetic peptide
  Seed: GAPRGPHGGAA (CTG1B_HUMAN)
GWPRGPHGGAM

SEQ ID NO: 31335 - protein, 9 aa, Artificial Sequence
  Description of Artificial Sequence: Synthetic peptide
  Seed: LTAADHRQL (CTG1B_HUMAN)
LAAADHRQF

SEQ ID NO: 31336 - protein, 10 aa, Artificial Sequence
  Description of Artificial Sequence: Synthetic peptide
  Seed: RLLEFYLAMP (CTG1B_HUMAN)
RLLEFYLAMT

SEQ ID NO: 31337 - protein, 10 aa, Artificial Sequence
  Description of Artificial Sequence: Synthetic peptide
  Seed: SLLMWITQCF (CTG1B_HUMAN)
SQLMWITQCM

SEQ ID NO: 31338 - protein, 10 aa, Artificial Sequence
  Description of Artificial Sequence: Synthetic peptide
  Seed: AMPFATPMEA (CTG1B_HUMAN)
ALPFATPMEL

SEQ ID NO: 31339 - protein, 9 aa, Artificial Sequence
  Description of Artificial Sequence: Synthetic peptide
  Seed: LLMWITQCF (CTG1B_HUMAN)
LHMWITQCM

SEQ ID NO: 31340 - protein, 11 aa, Artificial Sequence
  Description of Artificial Sequence: Synthetic peptide
  Seed: YLAMPFATPME (CTG1B_HUMAN)
YPAMPFATPMV

SEQ ID NO: 31341 - protein, 10 aa, Artificial Sequence
  Description of Artificial Sequence: Synthetic peptide
  Seed: ASGPGGGAPR (CTG1B_HUMAN)
ALGPGGGAPK

SEQ ID NO: 31342 - protein, 9 aa, Artificial Sequence
  Description of Artificial Sequence: Synthetic peptide
  Seed: LLMWITQCF (CTG1B_HUMAN)
LSMWITQCF

SEQ ID NO: 31343 - protein, 9 aa, Artificial Sequence
  Description of Artificial Sequence: Synthetic peptide
  Seed: RQLQLSISS (CTG1B_HUMAN)
RMLQLSISF

SEQ ID NO: 31344 - protein, 9 aa, Artificial Sequence
  Description of Artificial Sequence: Synthetic peptide
  Seed: SLAQDAPPL (CTG1B_HUMAN)
STAQDAPPL

SEQ ID NO: 31345 - protein, 10 aa, Artificial Sequence
  Description of Artificial Sequence: Synthetic peptide
  Seed: RGPESRLLEF (CTG1B_HUMAN)
RAPESRLLEL

SEQ ID NO: 31346 - protein, 10 aa, Artificial Sequence
  Description of Artificial Sequence: Synthetic peptide
  Seed: KEFTVSGNIL (CTG1B_HUMAN)
KQFTVSGNIF

SEQ ID NO: 31347 - protein, 11 aa, Artificial Sequence
  Description of Artificial Sequence: Synthetic peptide
  Seed: RLLEFYLAMPF (CTG1B_HUMAN)
RPLEFYLAMPV

SEQ ID NO: 31348 - protein, 9 aa, Artificial Sequence
  Description of Artificial Sequence: Synthetic peptide
  Seed: YLAMPFATP (CTG1B_HUMAN)
YMAMPFATI

SEQ ID NO: 31349 - protein, 9 aa, Artificial Sequence
  Description of Artificial Sequence: Synthetic peptide
  Seed: FATPMEAEL (CTG1B_HUMAN)
FWTPMEAEL

SEQ ID NO: 31350 - protein, 9 aa, Artificial Sequence
  Description of Artificial Sequence: Synthetic peptide
  Seed: LQQLSLLMW (CTG1B_HUMAN)
LTQLSLLMF

SEQ ID NO: 31351 - protein, 9 aa, Artificial Sequence
  Description of Artificial Sequence: Synthetic peptide
  Seed: FTVSGNILT (CTG1B_HUMAN)
FQVSGNILI

SEQ ID NO: 31352 - protein, 10 aa, Artificial Sequence
  Description of Artificial Sequence: Synthetic peptide
  Seed: AMPFATPMEA (CTG1B_HUMAN)
AMPFATPMEY

SEQ ID NO: 31353 - protein, 10 aa, Artificial Sequence
  Description of Artificial Sequence: Synthetic peptide
  Seed: RSLAQDAPPL (CTG1B_HUMAN)
RILAQDAPPV

SEQ ID NO: 31354 - protein, 9 aa, Artificial Sequence
  Description of Artificial Sequence: Synthetic peptide
  Seed: LQQLSLLMW (CTG1B_HUMAN)
LMQLSLLMY

SEQ ID NO: 31355 - protein, 9 aa, Artificial Sequence
  Description of Artificial Sequence: Synthetic peptide
  Seed: RQLQLSISS (CTG1B_HUMAN)
RLLQLSISF

SEQ ID NO: 31356 - protein, 9 aa, Artificial Sequence
  Description of Artificial Sequence: Synthetic peptide
  Seed: GPESRLLEF (CTG1B_HUMAN)
GPESRLLEL

SEQ ID NO: 31357 - protein, 11 aa, Artificial Sequence
  Description of Artificial Sequence: Synthetic peptide
  Seed: AEGRGTGGSTG (CTG1B_HUMAN)
AEGRGTGGSTA

SEQ ID NO: 31358 - protein, 10 aa, Artificial Sequence
  Description of Artificial Sequence: Synthetic peptide
  Seed: ASGPGGGAPR (CTG1B_HUMAN)
ASGPGGGAPF

SEQ ID NO: 31359 - protein, 9 aa, Artificial Sequence
  Description of Artificial Sequence: Synthetic peptide
  Seed: SGPGGGAPR (CTG1B_HUMAN)
SRPGGGAPL

SEQ ID NO: 31360 - protein, 9 aa, Artificial Sequence
  Description of Artificial Sequence: Synthetic peptide
  Seed: LLMWITQCF (CTG1B_HUMAN)
LKMWITQCM

SEQ ID NO: 31361 - protein, 9 aa, Artificial Sequence
  Description of Artificial Sequence: Synthetic peptide
  Seed: LLMWITQCF (CTG1B_HUMAN)
LKMWITQCY

SEQ ID NO: 31362 - protein, 11 aa, Artificial Sequence
  Description of Artificial Sequence: Synthetic peptide
  Seed: RLLEFYLAMPF (CTG1B_HUMAN)
RALEFYLAMPM

SEQ ID NO: 31363 - protein, 9 aa, Artificial Sequence
  Description of Artificial Sequence: Synthetic peptide
  Seed: RLLEFYLAM (CTG1B_HUMAN)
RMLEFYLAR

SEQ ID NO: 31364 - protein, 9 aa, Artificial Sequence
  Description of Artificial Sequence: Synthetic peptide
  Seed: LQLSISSCL (CTG1B_HUMAN)
LMLSISSCI

SEQ ID NO: 31365 - protein, 9 aa, Artificial Sequence
  Description of Artificial Sequence: Synthetic peptide
  Seed: ARGPESRLL (CTG1B_HUMAN)
AHGPESRLL

SEQ ID NO: 31366 - protein, 9 aa, Artificial Sequence
  Description of Artificial Sequence: Synthetic peptide
  Seed: IPDGPGGNA (CTG1B_HUMAN)
ITDGPGGNV

SEQ ID NO: 31367 - protein, 10 aa, Artificial Sequence
  Description of Artificial Sequence: Synthetic peptide
  Seed: LAQPPSGQRR (CTG1B_HUMAN)
LTQPPSGQRK

SEQ ID NO: 31368 - protein, 9 aa, Artificial Sequence
  Description of Artificial Sequence: Synthetic peptide
  Seed: SISSCLQQL (CTG1B_HUMAN)
SASSCLQQY

SEQ ID NO: 31369 - protein, 11 aa, Artificial Sequence
  Description of Artificial Sequence: Synthetic peptide
  Seed: RQLQLSISSCL (CTG1B_HUMAN)
RGLQLSISSCY

SEQ ID NO: 31370 - protein, 9 aa, Artificial Sequence
  Description of Artificial Sequence: Synthetic peptide
  Seed: LTAADHRQL (CTG1B_HUMAN)
LTAADHRQF

SEQ ID NO: 31371 - protein, 10 aa, Artificial Sequence
  Description of Artificial Sequence: Synthetic peptide
  Seed: RGPHGGAASG (CTG1B_HUMAN)
RDPHGGAASV

SEQ ID NO: 31372 - protein, 11 aa, Artificial Sequence
  Description of Artificial Sequence: Synthetic peptide
  Seed: MPFATPMEAEL (CTG1B_HUMAN)
MPFATPMEAEA

SEQ ID NO: 31373 - protein, 9 aa, Artificial Sequence
  Description of Artificial Sequence: Synthetic peptide
  Seed: YLAMPFATP (CTG1B_HUMAN)
YQAMPFATA

SEQ ID NO: 31374 - protein, 10 aa, Artificial Sequence
  Description of Artificial Sequence: Synthetic peptide
  Seed: RLTAADHRQL (CTG1B_HUMAN)
RFTAADHRQF

SEQ ID NO: 31375 - protein, 9 aa, Artificial Sequence
  Description of Artificial Sequence: Synthetic peptide
  Seed: WITQCFLPV (CTG1B_HUMAN)
WQTQCFLPM

SEQ ID NO: 31376 - protein, 11 aa, Artificial Sequence
  Description of Artificial Sequence: Synthetic peptide
  Seed: LMWITQCFLPV (CTG1B_HUMAN)
LLWITQCFLPV

SEQ ID NO: 31377 - protein, 10 aa, Artificial Sequence
  Description of Artificial Sequence: Synthetic peptide
  Seed: ASGPGGGAPR (CTG1B_HUMAN)
AVGPGGGAPY

SEQ ID NO: 31378 - protein, 9 aa, Artificial Sequence
  Description of Artificial Sequence: Synthetic peptide
  Seed: FATPMEAEL (CTG1B_HUMAN)
FSTPMEAEW

SEQ ID NO: 31379 - protein, 10 aa, Artificial Sequence
  Description of Artificial Sequence: Synthetic peptide
  Seed: AQDAPPLPVP (CTG1B_HUMAN)
AEDAPPLPVP

SEQ ID NO: 31380 - protein, 9 aa, Artificial Sequence
  Description of Artificial Sequence: Synthetic peptide
  Seed: AQDAPPLPV (CTG1B_HUMAN)
AIDAPPLPI

SEQ ID NO: 31381 - protein, 9 aa, Artificial Sequence
  Description of Artificial Sequence: Synthetic peptide
  Seed: MQAEGRGTG (CTG1B_HUMAN)
MQAEGRGTF

SEQ ID NO: 31382 - protein, 10 aa, Artificial Sequence
  Description of Artificial Sequence: Synthetic peptide
  Seed: EFTVSGNILT (CTG1B_HUMAN)
EDTVSGNILV

SEQ ID NO: 31383 - protein, 9 aa, Artificial Sequence
  Description of Artificial Sequence: Synthetic peptide
  Seed: LAMPFATPM (CTG1B_HUMAN)
LLMPFATPK

SEQ ID NO: 31384 - protein, 9 aa, Artificial Sequence
  Description of Artificial Sequence: Synthetic peptide
  Seed: VSGNILTIR (CTG1B_HUMAN)
VVGNILTIR

SEQ ID NO: 31385 - protein, 9 aa, Artificial Sequence
  Description of Artificial Sequence: Synthetic peptide
  Seed: SSCLQQLSL (CTG1B_HUMAN)
SMCLQQLSY

SEQ ID NO: 31386 - protein, 10 aa, Artificial Sequence
  Description of Artificial Sequence: Synthetic peptide
  Seed: MEAELARRSL (CTG1B_HUMAN)
MPAELARRSF

SEQ ID NO: 31387 - protein, 10 aa, Artificial Sequence
  Description of Artificial Sequence: Synthetic peptide
  Seed: MWITQCFLPV (CTG1B_HUMAN)
MQITQCFLPI

SEQ ID NO: 31388 - protein, 9 aa, Artificial Sequence
  Description of Artificial Sequence: Synthetic peptide
  Seed: TVSGNILTI (CTG1B_HUMAN)
TISGNILTA

SEQ ID NO: 31389 - protein, 10 aa, Artificial Sequence
  Description of Artificial Sequence: Synthetic peptide
  Seed: RGPESRLLEF (CTG1B_HUMAN)
RFPESRLLEM

SEQ ID NO: 31390 - protein, 9 aa, Artificial Sequence
  Description of Artificial Sequence: Synthetic peptide
  Seed: LMWITQCFL (CTG1B_HUMAN)
LMWITQCFF

SEQ ID NO: 31391 - protein, 10 aa, Artificial Sequence
  Description of Artificial Sequence: Synthetic peptide
  Seed: MEAELARRSL (CTG1B_HUMAN)
MAAELARRSM

SEQ ID NO: 31392 - protein, 11 aa, Artificial Sequence
  Description of Artificial Sequence: Synthetic peptide
  Seed: RQLQLSISSCL (CTG1B_HUMAN)
RPLQLSISSCY

SEQ ID NO: 31393 - protein, 9 aa, Artificial Sequence
  Description of Artificial Sequence: Synthetic peptide
  Seed: YLAMPFATP (CTG1B_HUMAN)
YMAMPFATA

SEQ ID NO: 31394 - protein, 9 aa, Artificial Sequence
  Description of Artificial Sequence: Synthetic peptide
  Seed: LAQPPSGQR (CTG1B_HUMAN)
LTQPPSGQK

SEQ ID NO: 31395 - protein, 9 aa, Artificial Sequence
  Description of Artificial Sequence: Synthetic peptide
  Seed: AQDAPPLPV (CTG1B_HUMAN)
AVDAPPLPV

SEQ ID NO: 31396 - protein, 10 aa, Artificial Sequence
  Description of Artificial Sequence: Synthetic peptide
  Seed: FYLAMPFATP (CTG1B_HUMAN)
FDLAMPFATV

SEQ ID NO: 31397 - protein, 9 aa, Artificial Sequence
  Description of Artificial Sequence: Synthetic peptide
  Seed: LMWITQCFL (CTG1B_HUMAN)
LQWITQCFY

SEQ ID NO: 31398 - protein, 10 aa, Artificial Sequence
  Description of Artificial Sequence: Synthetic peptide
  Seed: LLEFYLAMPF (CTG1B_HUMAN)
LLEFYLAMPL

SEQ ID NO: 31399 - protein, 10 aa, Artificial Sequence
  Description of Artificial Sequence: Synthetic peptide
  Seed: RGPHGGAASG (CTG1B_HUMAN)
RRPHGGAASI

SEQ ID NO: 31400 - protein, 10 aa, Artificial Sequence
  Description of Artificial Sequence: Synthetic peptide
  Seed: LLMWITQCFL (CTG1B_HUMAN)
LLMWITQCFM

SEQ ID NO: 31401 - protein, 9 aa, Artificial Sequence
  Description of Artificial Sequence: Synthetic peptide
  Seed: SSCLQQLSL (CTG1B_HUMAN)
SSCLQQLSF

SEQ ID NO: 31402 - protein, 10 aa, Artificial Sequence
  Description of Artificial Sequence: Synthetic peptide
  Seed: SRLLEFYLAM (CTG1B_HUMAN)
STLLEFYLAV

SEQ ID NO: 31403 - protein, 9 aa, Artificial Sequence
  Description of Artificial Sequence: Synthetic peptide
  Seed: FTVSGNILT (CTG1B_HUMAN)
FLVSGNILA

SEQ ID NO: 31404 - protein, 9 aa, Artificial Sequence
  Description of Artificial Sequence: Synthetic peptide
  Seed: GPHGGAASG (CTG1B_HUMAN)
GPHGGAASI

SEQ ID NO: 31405 - protein, 10 aa, Artificial Sequence
  Description of Artificial Sequence: Synthetic peptide
  Seed: NILTIRLTAA (CTG1B_HUMAN)
NLLTIRLTAV

SEQ ID NO: 31406 - protein, 9 aa, Artificial Sequence
  Description of Artificial Sequence: Synthetic peptide
  Seed: APRGPHGGA (CTG1B_HUMAN)
AVRGPHGGL

SEQ ID NO: 31407 - protein, 10 aa, Artificial Sequence
  Description of Artificial Sequence: Synthetic peptide
  Seed: IPDGPGGNAG (CTG1B_HUMAN)
IADGPGGNAF

SEQ ID NO: 31408 - protein, 9 aa, Artificial Sequence
  Description of Artificial Sequence: Synthetic peptide
  Seed: TVSGNILTI (CTG1B_HUMAN)
TTSGNILTF

SEQ ID NO: 31409 - protein, 10 aa, Artificial Sequence
  Description of Artificial Sequence: Synthetic peptide
  Seed: FYLAMPFATP (CTG1B_HUMAN)
FGLAMPFATI

SEQ ID NO: 31410 - protein, 10 aa, Artificial Sequence
  Description of Artificial Sequence: Synthetic peptide
  Seed: RGPHGGAASG (CTG1B_HUMAN)
REPHGGAASL

SEQ ID NO: 31411 - protein, 10 aa, Artificial Sequence
  Description of Artificial Sequence: Synthetic peptide
  Seed: LLEFYLAMPF (CTG1B_HUMAN)
LPEFYLAMPY

SEQ ID NO: 31412 - protein, 11 aa, Artificial Sequence
  Description of Artificial Sequence: Synthetic peptide
  Seed: GPRGAGAARAS (CTG1B_HUMAN)
GPRGAGAARAC

SEQ ID NO: 31413 - protein, 9 aa, Artificial Sequence
  Description of Artificial Sequence: Synthetic peptide
  Seed: RLLEFYLAM (CTG1B_HUMAN)
RMLEFYLAG

SEQ ID NO: 31414 - protein, 9 aa, Artificial Sequence
  Description of Artificial Sequence: Synthetic peptide
  Seed: TQCFLPVFL (CTG1B_HUMAN)
THCFLPVFI

SEQ ID NO: 31415 - protein, 10 aa, Artificial Sequence
  Description of Artificial Sequence: Synthetic peptide
  Seed: LLEFYLAMPF (CTG1B_HUMAN)
LKEFYLAMPY

SEQ ID NO: 31416 - protein, 9 aa, Artificial Sequence
  Description of Artificial Sequence: Synthetic peptide
  Seed: MQAEGRGTG (CTG1B_HUMAN)
MQAEGRGTI

SEQ ID NO: 31417 - protein, 11 aa, Artificial Sequence
  Description of Artificial Sequence: Synthetic peptide
  Seed: RLLEFYLAMPF (CTG1B_HUMAN)
RWLEFYLAMPM

SEQ ID NO: 31418 - protein, 10 aa, Artificial Sequence
  Description of Artificial Sequence: Synthetic peptide
  Seed: ITQCFLPVFL (CTG1B_HUMAN)
IMQCFLPVFI

SEQ ID NO: 31419 - protein, 11 aa, Artificial Sequence
  Description of Artificial Sequence: Synthetic peptide
  Seed: FYLAMPFATPM (CTG1B_HUMAN)
FELAMPFATPL

SEQ ID NO: 31420 - protein, 10 aa, Artificial Sequence
  Description of Artificial Sequence: Synthetic peptide
  Seed: YLAMPFATPM (CTG1B_HUMAN)
YLAMPFATPS

SEQ ID NO: 31421 - protein, 9 aa, Artificial Sequence
  Description of Artificial Sequence: Synthetic peptide
  Seed: FTVSGNILT (CTG1B_HUMAN)
FIVSGNILL

SEQ ID NO: 31422 - protein, 9 aa, Artificial Sequence
  Description of Artificial Sequence: Synthetic peptide
  Seed: RLLEFYLAM (CTG1B_HUMAN)
RLLEFYLAC

SEQ ID NO: 31423 - protein, 10 aa, Artificial Sequence
  Description of Artificial Sequence: Synthetic peptide
  Seed: FTVSGNILTI (CTG1B_HUMAN)
FVVSGNILTW

SEQ ID NO: 31424 - protein, 10 aa, Artificial Sequence
  Description of Artificial Sequence: Synthetic peptide
  Seed: YLAMPFATPM (CTG1B_HUMAN)
YTAMPFATPA

SEQ ID NO: 31425 - protein, 9 aa, Artificial Sequence
  Description of Artificial Sequence: Synthetic peptide
  Seed: IPDGPGGNA (CTG1B_HUMAN)
IFDGPGGNM

SEQ ID NO: 31426 - protein, 10 aa, Artificial Sequence
  Description of Artificial Sequence: Synthetic peptide
  Seed: GAPRGPHGGA (CTG1B_HUMAN)
GEPRGPHGGM

SEQ ID NO: 31427 - protein, 9 aa, Artificial Sequence
  Description of Artificial Sequence: Synthetic peptide
  Seed: AADHRQLQL (CTG1B_HUMAN)
ADDHRQLQL

SEQ ID NO: 31428 - protein, 10 aa, Artificial Sequence
  Description of Artificial Sequence: Synthetic peptide
  Seed: YLAMPFATPM (CTG1B_HUMAN)
YMAMPFATPF

SEQ ID NO: 31429 - protein, 9 aa, Artificial Sequence
  Description of Artificial Sequence: Synthetic peptide
  Seed: AQDAPPLPV (CTG1B_HUMAN)
AADAPPLPC

SEQ ID NO: 31430 - protein, 9 aa, Artificial Sequence
  Description of Artificial Sequence: Synthetic peptide
  Seed: SGPGGGAPR (CTG1B_HUMAN)
SMPGGGAPM

SEQ ID NO: 31431 - protein, 10 aa, Artificial Sequence
  Description of Artificial Sequence: Synthetic peptide
  Seed: LLMWITQCFL (CTG1B_HUMAN)
LVMWITQCFL

SEQ ID NO: 31432 - protein, 9 aa, Artificial Sequence
  Description of Artificial Sequence: Synthetic peptide
  Seed: IPDGPGGNA (CTG1B_HUMAN)
ILDGPGGNI

SEQ ID NO: 31433 - protein, 10 aa, Artificial Sequence
  Description of Artificial Sequence: Synthetic peptide
  Seed: LLMWITQCFL (CTG1B_HUMAN)
LTMWITQCFV

SEQ ID NO: 31434 - protein, 9 aa, Artificial Sequence
  Description of Artificial Sequence: Synthetic peptide
  Seed: APRGPHGGA (CTG1B_HUMAN)
APRGPHGGF

SEQ ID NO: 31435 - protein, 9 aa, Artificial Sequence
  Description of Artificial Sequence: Synthetic peptide
  Seed: RASGPGGGA (CTG1B_HUMAN)
RASGPGGGY

SEQ ID NO: 31436 - protein, 9 aa, Artificial Sequence
  Description of Artificial Sequence: Synthetic peptide
  Seed: TVSGNILTI (CTG1B_HUMAN)
TISGNILTM

SEQ ID NO: 31437 - protein, 9 aa, Artificial Sequence
  Description of Artificial Sequence: Synthetic peptide
  Seed: FATPMEAEL (CTG1B_HUMAN)
FYTPMEAEF

SEQ ID NO: 31438 - protein, 10 aa, Artificial Sequence
  Description of Artificial Sequence: Synthetic peptide
  Seed: IPDGPGGNAG (CTG1B_HUMAN)
IADGPGGNAY

SEQ ID NO: 31439 - protein, 9 aa, Artificial Sequence
  Description of Artificial Sequence: Synthetic peptide
  Seed: MPFATPMEA (CTG1B_HUMAN)
MRFATPMEA

SEQ ID NO: 31440 - protein, 9 aa, Artificial Sequence
  Description of Artificial Sequence: Synthetic peptide
  Seed: MPFATPMEA (CTG1B_HUMAN)
MYFATPMEF

SEQ ID NO: 31441 - protein, 9 aa, Artificial Sequence
  Description of Artificial Sequence: Synthetic peptide
  Seed: AARASGPGG (CTG1B_HUMAN)
AIRASGPGL

SEQ ID NO: 31442 - protein, 10 aa, Artificial Sequence
  Description of Artificial Sequence: Synthetic peptide
  Seed: YLAMPFATPM (CTG1B_HUMAN)
YCAMPFATPL

SEQ ID NO: 31443 - protein, 11 aa, Artificial Sequence
  Description of Artificial Sequence: Synthetic peptide
  Seed: RQLQLSISSCL (CTG1B_HUMAN)
RQLQLSISSCY

SEQ ID NO: 31444 - protein, 10 aa, Artificial Sequence
  Description of Artificial Sequence: Synthetic peptide
  Seed: FLPVFLAQPP (CTG1B_HUMAN)
FQPVFLAQPI

SEQ ID NO: 31445 - protein, 10 aa, Artificial Sequence
  Description of Artificial Sequence: Synthetic peptide
  Seed: RGPESRLLEF (CTG1B_HUMAN)
RVPESRLLEL

SEQ ID NO: 31446 - protein, 10 aa, Artificial Sequence
  Description of Artificial Sequence: Synthetic peptide
  Seed: YLAMPFATPM (CTG1B_HUMAN)
YEAMPFATPA

SEQ ID NO: 31447 - protein, 10 aa, Artificial Sequence
  Description of Artificial Sequence: Synthetic peptide
  Seed: YLAMPFATPM (CTG1B_HUMAN)
YEAMPFATPM

SEQ ID NO: 31448 - protein, 10 aa, Artificial Sequence
  Description of Artificial Sequence: Synthetic peptide
  Seed: FYLAMPFATP (CTG1B_HUMAN)
FLLAMPFATM

SEQ ID NO: 31449 - protein, 9 aa, Artificial Sequence
  Description of Artificial Sequence: Synthetic peptide
  Seed: QQLSLLMWI (CTG1B_HUMAN)
QRLSLLMWV

SEQ ID NO: 31450 - protein, 11 aa, Artificial Sequence
  Description of Artificial Sequence: Synthetic peptide
  Seed: RLLEFYLAMPF (CTG1B_HUMAN)
RTLEFYLAMPW

SEQ ID NO: 31451 - protein, 10 aa, Artificial Sequence
  Description of Artificial Sequence: Synthetic peptide
  Seed: FTVSGNILTI (CTG1B_HUMAN)
FGVSGNILTW

SEQ ID NO: 31452 - protein, 11 aa, Artificial Sequence
  Description of Artificial Sequence: Synthetic peptide
  Seed: GEAGATGGRGP (CTG1B_HUMAN)
GEAGATGGRGM

SEQ ID NO: 31453 - protein, 10 aa, Artificial Sequence
  Description of Artificial Sequence: Synthetic peptide
  Seed: TVSGNILTIR (CTG1B_HUMAN)
TSSGNILTIR

SEQ ID NO: 31454 - protein, 10 aa, Artificial Sequence
  Description of Artificial Sequence: Synthetic peptide
  Seed: APPLPVPGVL (CTG1B_HUMAN)
ACPLPVPGVL

SEQ ID NO: 31455 - protein, 9 aa, Artificial Sequence
  Description of Artificial Sequence: Synthetic peptide
  Seed: ITQCFLPVF (CTG1B_HUMAN)
IFQCFLPVW

SEQ ID NO: 31456 - protein, 9 aa, Artificial Sequence
  Description of Artificial Sequence: Synthetic peptide
  Seed: QQLSLLMWI (CTG1B_HUMAN)
QTLSLLMWI

SEQ ID NO: 31457 - protein, 9 aa, Artificial Sequence
  Description of Artificial Sequence: Synthetic peptide
  Seed: GPHGGAASG (CTG1B_HUMAN)
GPHGGAASL

SEQ ID NO: 31458 - protein, 9 aa, Artificial Sequence
  Description of Artificial Sequence: Synthetic peptide
  Seed: TVSGNILTI (CTG1B_HUMAN)
TGSGNILTW

SEQ ID NO: 31459 - protein, 11 aa, Artificial Sequence
  Description of Artificial Sequence: Synthetic peptide
  Seed: SLLMWITQCFL (CTG1B_HUMAN)
SHLMWITQCFV

SEQ ID NO: 31460 - protein, 9 aa, Artificial Sequence
  Description of Artificial Sequence: Synthetic peptide
  Seed: LPVFLAQPP (CTG1B_HUMAN)
LPVFLAQPW

SEQ ID NO: 31461 - protein, 10 aa, Artificial Sequence
  Description of Artificial Sequence: Synthetic peptide
  Seed: MWITQCFLPV (CTG1B_HUMAN)
MLITQCFLPI

SEQ ID NO: 31462 - protein, 9 aa, Artificial Sequence
  Description of Artificial Sequence: Synthetic peptide
  Seed: MPFATPMEA (CTG1B_HUMAN)
MSFATPMEY

SEQ ID NO: 31463 - protein, 9 aa, Artificial Sequence
  Description of Artificial Sequence: Synthetic peptide
  Seed: LEFYLAMPF (CTG1B_HUMAN)
LPFYLAMPY

SEQ ID NO: 31464 - protein, 8 aa, Artificial Sequence
  Description of Artificial Sequence: Synthetic peptide
  Seed: YLAMPFAT (CTG1B_HUMAN)
YLAMPFAV

SEQ ID NO: 31465 - protein, 9 aa, Artificial Sequence
  Description of Artificial Sequence: Synthetic peptide
  Seed: AQDAPPLPV (CTG1B_HUMAN)
AEDAPPLPA

SEQ ID NO: 31466 - protein, 9 aa, Artificial Sequence
  Description of Artificial Sequence: Synthetic peptide
  Seed: RLLEFYLAM (CTG1B_HUMAN)
RQLEFYLAR

SEQ ID NO: 31467 - protein, 10 aa, Artificial Sequence
  Description of Artificial Sequence: Synthetic peptide
  Seed: FTVSGNILTI (CTG1B_HUMAN)
FMVSGNILTS

SEQ ID NO: 31468 - protein, 11 aa, Artificial Sequence
  Description of Artificial Sequence: Synthetic peptide
  Seed: FYLAMPFATPM (CTG1B_HUMAN)
FCLAMPFATPM

SEQ ID NO: 31469 - protein, 11 aa, Artificial Sequence
  Description of Artificial Sequence: Synthetic peptide
  Seed: RASGPGGGAPR (CTG1B_HUMAN)
RQSGPGGGAPY

SEQ ID NO: 31470 - protein, 9 aa, Artificial Sequence
  Description of Artificial Sequence: Synthetic peptide
  Seed: YLAMPFATP (CTG1B_HUMAN)
YAAMPFATI

SEQ ID NO: 31471 - protein, 9 aa, Artificial Sequence
  Description of Artificial Sequence: Synthetic peptide
  Seed: AADHRQLQL (CTG1B_HUMAN)
AQDHRQLQV

SEQ ID NO: 31472 - protein, 11 aa, Artificial Sequence
  Description of Artificial Sequence: Synthetic peptide
  Seed: FYLAMPFATPM (CTG1B_HUMAN)
FDLAMPFATPY

SEQ ID NO: 31473 - protein, 9 aa, Artificial Sequence
  Description of Artificial Sequence: Synthetic peptide
  Seed: AQDAPPLPV (CTG1B_HUMAN)
AWDAPPLPM

SEQ ID NO: 31474 - protein, 10 aa, Artificial Sequence
  Description of Artificial Sequence: Synthetic peptide
  Seed: RASGPGGGAP (CTG1B_HUMAN)
RISGPGGGAY

SEQ ID NO: 31475 - protein, 10 aa, Artificial Sequence
  Description of Artificial Sequence: Synthetic peptide
  Seed: MWITQCFLPV (CTG1B_HUMAN)
MQITQCFLPM

SEQ ID NO: 31476 - protein, 9 aa, Artificial Sequence
  Description of Artificial Sequence: Synthetic peptide
  Seed: LAMPFATPM (CTG1B_HUMAN)
LYMPFATPT

SEQ ID NO: 31477 - protein, 8 aa, Artificial Sequence
  Description of Artificial Sequence: Synthetic peptide
  Seed: GPRGAGAA (CTG1B_HUMAN)
GPRGAGAV

SEQ ID NO: 31478 - protein, 10 aa, Artificial Sequence
  Description of Artificial Sequence: Synthetic peptide
  Seed: LLEFYLAMPF (CTG1B_HUMAN)
LIEFYLAMPW

SEQ ID NO: 31479 - protein, 9 aa, Artificial Sequence
  Description of Artificial Sequence: Synthetic peptide
  Seed: LLMWITQCF (CTG1B_HUMAN)
LSMWITQCM

SEQ ID NO: 31480 - protein, 9 aa, Artificial Sequence
  Description of Artificial Sequence: Synthetic peptide
  Seed: RLLEFYLAM (CTG1B_HUMAN)
RELEFYLAV

SEQ ID NO: 31481 - protein, 8 aa, Artificial Sequence
  Description of Artificial Sequence: Synthetic peptide
  Seed: TQCFLPVF (CTG1B_HUMAN)
TQCFLPVV

SEQ ID NO: 31482 - protein, 10 aa, Artificial Sequence
  Description of Artificial Sequence: Synthetic peptide
  Seed: FYLAMPFATP (CTG1B_HUMAN)
FYLAMPFATV

SEQ ID NO: 31483 - protein, 9 aa, Artificial Sequence
  Description of Artificial Sequence: Synthetic peptide
  Seed: LLMWITQCF (CTG1B_HUMAN)
LAMWITQCV

SEQ ID NO: 31484 - protein, 9 aa, Artificial Sequence
  Description of Artificial Sequence: Synthetic peptide
  Seed: AADHRQLQL (CTG1B_HUMAN)
AADHRQLQY

SEQ ID NO: 31485 - protein, 9 aa, Artificial Sequence
  Description of Artificial Sequence: Synthetic peptide
  Seed: LAMPFATPM (CTG1B_HUMAN)
LNMPFATPF

SEQ ID NO: 31486 - protein, 10 aa, Artificial Sequence
  Description of Artificial Sequence: Synthetic peptide
  Seed: GIPDGPGGNA (CTG1B_HUMAN)
GIPDGPGGNY

SEQ ID NO: 31487 - protein, 9 aa, Artificial Sequence
  Description of Artificial Sequence: Synthetic peptide
  Seed: WITQCFLPV (CTG1B_HUMAN)
WSTQCFLPV

SEQ ID NO: 31488 - protein, 11 aa, Artificial Sequence
  Description of Artificial Sequence: Synthetic peptide
  Seed: RLLEFYLAMPF (CTG1B_HUMAN)
RSLEFYLAMPV

SEQ ID NO: 31489 - protein, 9 aa, Artificial Sequence
  Description of Artificial Sequence: Synthetic peptide
  Seed: RLLEFYLAM (CTG1B_HUMAN)
RQLEFYLAW

SEQ ID NO: 31490 - protein, 11 aa, Artificial Sequence
  Description of Artificial Sequence: Synthetic peptide
  Seed: RQLQLSISSCL (CTG1B_HUMAN)
RCLQLSISSCF

SEQ ID NO: 31491 - protein, 10 aa, Artificial Sequence
  Description of Artificial Sequence: Synthetic peptide
  Seed: SRLLEFYLAM (CTG1B_HUMAN)
SYLLEFYLAV

SEQ ID NO: 31492 - protein, 9 aa, Artificial Sequence
  Description of Artificial Sequence: Synthetic peptide
  Seed: TVSGNILTI (CTG1B_HUMAN)
TTSGNILTY

SEQ ID NO: 31493 - protein, 9 aa, Artificial Sequence
  Description of Artificial Sequence: Synthetic peptide
  Seed: RLLEFYLAM (CTG1B_HUMAN)
RALEFYLAA

SEQ ID NO: 31494 - protein, 10 aa, Artificial Sequence
  Description of Artificial Sequence: Synthetic peptide
  Seed: GEAGATGGRG (CTG1B_HUMAN)
GEAGATGGRA

SEQ ID NO: 31495 - protein, 10 aa, Artificial Sequence
  Description of Artificial Sequence: Synthetic peptide
  Seed: YLAMPFATPM (CTG1B_HUMAN)
YTAMPFATPF

SEQ ID NO: 31496 - protein, 9 aa, Artificial Sequence
  Description of Artificial Sequence: Synthetic peptide
  Seed: RLLEFYLAM (CTG1B_HUMAN)
RMLEFYLAV

SEQ ID NO: 31497 - protein, 10 aa, Artificial Sequence
  Description of Artificial Sequence: Synthetic peptide
  Seed: EFTVSGNILT (CTG1B_HUMAN)
ESTVSGNILV

SEQ ID NO: 31498 - protein, 10 aa, Artificial Sequence
  Description of Artificial Sequence: Synthetic peptide
  Seed: RGPHGGAASG (CTG1B_HUMAN)
RKPHGGAASV

SEQ ID NO: 31499 - protein, 11 aa, Artificial Sequence
  Description of Artificial Sequence: Synthetic peptide
  Seed: RLLEFYLAMPF (CTG1B_HUMAN)
RVLEFYLAMPW

SEQ ID NO: 31500 - protein, 10 aa, Artificial Sequence
  Description of Artificial Sequence: Synthetic peptide
  Seed: GAPRGPHGGA (CTG1B_HUMAN)
GLPRGPHGGM

SEQ ID NO: 31501 - protein, 9 aa, Artificial Sequence
  Description of Artificial Sequence: Synthetic peptide
  Seed: LEFYLAMPF (CTG1B_HUMAN)
LYFYLAMPY

SEQ ID NO: 31502 - protein, 11 aa, Artificial Sequence
  Description of Artificial Sequence: Synthetic peptide
  Seed: AARASGPGGGA (CTG1B_HUMAN)
APRASGPGGGM

SEQ ID NO: 31503 - protein, 9 aa, Artificial Sequence
  Description of Artificial Sequence: Synthetic peptide
  Seed: TPMEAELAR (CTG1B_HUMAN)
TIMEAELAY

SEQ ID NO: 31504 - protein, 9 aa, Artificial Sequence
  Description of Artificial Sequence: Synthetic peptide
  Seed: LAMPFATPM (CTG1B_HUMAN)
LAMPFATPW

SEQ ID NO: 31505 - protein, 9 aa, Artificial Sequence
  Description of Artificial Sequence: Synthetic peptide
  Seed: AARASGPGG (CTG1B_HUMAN)
ASRASGPGI

SEQ ID NO: 31506 - protein, 10 aa, Artificial Sequence
  Description of Artificial Sequence: Synthetic peptide
  Seed: RGPHGGAASG (CTG1B_HUMAN)
RVPHGGAASF

SEQ ID NO: 31507 - protein, 10 aa, Artificial Sequence
  Description of Artificial Sequence: Synthetic peptide
  Seed: RGPESRLLEF (CTG1B_HUMAN)
RIPESRLLEM

SEQ ID NO: 31508 - protein, 10 aa, Artificial Sequence
  Description of Artificial Sequence: Synthetic peptide
  Seed: ASGPGGGAPR (CTG1B_HUMAN)
ARGPGGGAPY

SEQ ID NO: 31509 - protein, 9 aa, Artificial Sequence
  Description of Artificial Sequence: Synthetic peptide
  Seed: WITQCFLPV (CTG1B_HUMAN)
WVTQCFLPL

SEQ ID NO: 31510 - protein, 10 aa, Artificial Sequence
  Description of Artificial Sequence: Synthetic peptide
  Seed: YLAMPFATPM (CTG1B_HUMAN)
YYAMPFATPL

SEQ ID NO: 31511 - protein, 11 aa, Artificial Sequence
  Description of Artificial Sequence: Synthetic peptide
  Seed: RLLEFYLAMPF (CTG1B_HUMAN)
RLLEFYLAMPV

SEQ ID NO: 31512 - protein, 10 aa, Artificial Sequence
  Description of Artificial Sequence: Synthetic peptide
  Seed: LLEFYLAMPF (CTG1B_HUMAN)
LPEFYLAMPF

SEQ ID NO: 31513 - protein, 10 aa, Artificial Sequence
  Description of Artificial Sequence: Synthetic peptide
  Seed: LLEFYLAMPF (CTG1B_HUMAN)
LREFYLAMPM

SEQ ID NO: 31514 - protein, 10 aa, Artificial Sequence
  Description of Artificial Sequence: Synthetic peptide
  Seed: RGPHGGAASG (CTG1B_HUMAN)
RDPHGGAASL

SEQ ID NO: 31515 - protein, 9 aa, Artificial Sequence
  Description of Artificial Sequence: Synthetic peptide
  Seed: AQPPSGQRR (CTG1B_HUMAN)
AAPPSGQRY

SEQ ID NO: 31516 - protein, 10 aa, Artificial Sequence
  Description of Artificial Sequence: Synthetic peptide
  Seed: ISSCLQQLSL (CTG1B_HUMAN)
ISSCLQQLSY

SEQ ID NO: 31517 - protein, 8 aa, Artificial Sequence
  Description of Artificial Sequence: Synthetic peptide
  Seed: LPVPGVLL (CTG1B_HUMAN)
LAVPGVLM

SEQ ID NO: 31518 - protein, 9 aa, Artificial Sequence
  Description of Artificial Sequence: Synthetic peptide
  Seed: AADHRQLQL (CTG1B_HUMAN)
ALDHRQLQL

SEQ ID NO: 31519 - protein, 10 aa, Artificial Sequence
  Description of Artificial Sequence: Synthetic peptide
  Seed: LSISSCLQQL (CTG1B_HUMAN)
LQISSCLQQV

SEQ ID NO: 31520 - protein, 10 aa, Artificial Sequence
  Description of Artificial Sequence: Synthetic peptide
  Seed: RLTAADHRQL (CTG1B_HUMAN)
RRTAADHRQF

SEQ ID NO: 31521 - protein, 9 aa, Artificial Sequence
  Description of Artificial Sequence: Synthetic peptide
  Seed: SSCLQQLSL (CTG1B_HUMAN)
SECLQQLSI

SEQ ID NO: 31522 - protein, 10 aa, Artificial Sequence
  Description of Artificial Sequence: Synthetic peptide
  Seed: RASGPGGGAP (CTG1B_HUMAN)
RSSGPGGGAF

SEQ ID NO: 31523 - protein, 9 aa, Artificial Sequence
  Description of Artificial Sequence: Synthetic peptide
  Seed: AARASGPGG (CTG1B_HUMAN)
AFRASGPGV

SEQ ID NO: 31524 - protein, 10 aa, Artificial Sequence
  Description of Artificial Sequence: Synthetic peptide
  Seed: FLPVFLAQPP (CTG1B_HUMAN)
FLPVFLAQPT

SEQ ID NO: 31525 - protein, 9 aa, Artificial Sequence
  Description of Artificial Sequence: Synthetic peptide
  Seed: LLMWITQCF (CTG1B_HUMAN)
LRMWITQCM

SEQ ID NO: 31526 - protein, 10 aa, Artificial Sequence
  Description of Artificial Sequence: Synthetic peptide
  Seed: SRLLEFYLAM (CTG1B_HUMAN)
SELLEFYLAA

SEQ ID NO: 31527 - protein, 9 aa, Artificial Sequence
  Description of Artificial Sequence: Synthetic peptide
  Seed: WITQCFLPV (CTG1B_HUMAN)
WTTQCFLPV

SEQ ID NO: 31528 - protein, 10 aa, Artificial Sequence
  Description of Artificial Sequence: Synthetic peptide
  Seed: GAPRGPHGGA (CTG1B_HUMAN)
GPPRGPHGGL

SEQ ID NO: 31529 - protein, 9 aa, Artificial Sequence
  Description of Artificial Sequence: Synthetic peptide
  Seed: LLMWITQCF (CTG1B_HUMAN)
LPMWITQCV

SEQ ID NO: 31530 - protein, 10 aa, Artificial Sequence
  Description of Artificial Sequence: Synthetic peptide
  Seed: YLAMPFATPM (CTG1B_HUMAN)
YAAMPFATPF

SEQ ID NO: 31531 - protein, 11 aa, Artificial Sequence
  Description of Artificial Sequence: Synthetic peptide
  Seed: YLAMPFATPME (CTG1B_HUMAN)
YLAMPFATPMM

SEQ ID NO: 31532 - protein, 10 aa, Artificial Sequence
  Description of Artificial Sequence: Synthetic peptide
  Seed: RASGPGGGAP (CTG1B_HUMAN)
RPSGPGGGAP

SEQ ID NO: 31533 - protein, 10 aa, Artificial Sequence
  Description of Artificial Sequence: Synthetic peptide
  Seed: FLPVFLAQPP (CTG1B_HUMAN)
FAPVFLAQPA

SEQ ID NO: 31534 - protein, 10 aa, Artificial Sequence
  Description of Artificial Sequence: Synthetic peptide
  Seed: LQQLSLLMWI (CTG1B_HUMAN)
LMQLSLLMWI

SEQ ID NO: 31535 - protein, 10 aa, Artificial Sequence
  Description of Artificial Sequence: Synthetic peptide
  Seed: SRLLEFYLAM (CTG1B_HUMAN)
SCLLEFYLAA

SEQ ID NO: 31536 - protein, 9 aa, Artificial Sequence
  Description of Artificial Sequence: Synthetic peptide
  Seed: GEAGATGGR (CTG1B_HUMAN)
GAAGATGGR

SEQ ID NO: 31537 - protein, 9 aa, Artificial Sequence
  Description of Artificial Sequence: Synthetic peptide
  Seed: LQLSISSCL (CTG1B_HUMAN)
LLLSISSCY

SEQ ID NO: 31538 - protein, 9 aa, Artificial Sequence
  Description of Artificial Sequence: Synthetic peptide
  Seed: RLLEFYLAM (CTG1B_HUMAN)
RLLEFYLAI

SEQ ID NO: 31539 - protein, 9 aa, Artificial Sequence
  Description of Artificial Sequence: Synthetic peptide
  Seed: LEFYLAMPF (CTG1B_HUMAN)
LPFYLAMPI

SEQ ID NO: 31540 - protein, 9 aa, Artificial Sequence
  Description of Artificial Sequence: Synthetic peptide
  Seed: AQDAPPLPV (CTG1B_HUMAN)
AVDAPPLPF

SEQ ID NO: 31541 - protein, 11 aa, Artificial Sequence
  Description of Artificial Sequence: Synthetic peptide
  Seed: RLLEFYLAMPF (CTG1B_HUMAN)
RELEFYLAMPA

SEQ ID NO: 31542 - protein, 10 aa, Artificial Sequence
  Description of Artificial Sequence: Synthetic peptide
  Seed: RLLEFYLAMP (CTG1B_HUMAN)
RVLEFYLAMA

SEQ ID NO: 31543 - protein, 11 aa, Artificial Sequence
  Description of Artificial Sequence: Synthetic peptide
  Seed: RASGPGGGAPR (CTG1B_HUMAN)
RPSGPGGGAPP

SEQ ID NO: 31544 - protein, 9 aa, Artificial Sequence
  Description of Artificial Sequence: Synthetic peptide
  Seed: AARASGPGG (CTG1B_HUMAN)
AVRASGPGI

SEQ ID NO: 31545 - protein, 10 aa, Artificial Sequence
  Description of Artificial Sequence: Synthetic peptide
  Seed: MPFATPMEAE (CTG1B_HUMAN)
MPFATPMEAM

SEQ ID NO: 31546 - protein, 9 aa, Artificial Sequence
  Description of Artificial Sequence: Synthetic peptide
  Seed: SSCLQQLSL (CTG1B_HUMAN)
SRCLQQLSF

SEQ ID NO: 31547 - protein, 10 aa, Artificial Sequence
  Description of Artificial Sequence: Synthetic peptide
  Seed: FYLAMPFATP (CTG1B_HUMAN)
FCLAMPFATA

SEQ ID NO: 31548 - protein, 10 aa, Artificial Sequence
  Description of Artificial Sequence: Synthetic peptide
  Seed: FTVSGNILTI (CTG1B_HUMAN)
FLVSGNILTA

SEQ ID NO: 31549 - protein, 9 aa, Artificial Sequence
  Description of Artificial Sequence: Synthetic peptide
  Seed: LEFYLAMPF (CTG1B_HUMAN)
LKFYLAMPF

SEQ ID NO: 31550 - protein, 10 aa, Artificial Sequence
  Description of Artificial Sequence: Synthetic peptide
  Seed: LSISSCLQQL (CTG1B_HUMAN)
LTISSCLQQM

SEQ ID NO: 31551 - protein, 10 aa, Artificial Sequence
  Description of Artificial Sequence: Synthetic peptide
  Seed: RLLEFYLAMP (CTG1B_HUMAN)
RMLEFYLAMT

SEQ ID NO: 31552 - protein, 9 aa, Artificial Sequence
  Description of Artificial Sequence: Synthetic peptide
  Seed: AQDAPPLPV (CTG1B_HUMAN)
AADAPPLPA

SEQ ID NO: 31553 - protein, 10 aa, Artificial Sequence
  Description of Artificial Sequence: Synthetic peptide
  Seed: FYLAMPFATP (CTG1B_HUMAN)
FMLAMPFATI

SEQ ID NO: 31554 - protein, 9 aa, Artificial Sequence
  Description of Artificial Sequence: Synthetic peptide
  Seed: KEFTVSGNI (CTG1B_HUMAN)
KQFTVSGNF

SEQ ID NO: 31555 - protein, 11 aa, Artificial Sequence
  Description of Artificial Sequence: Synthetic peptide
  Seed: FYLAMPFATPM (CTG1B_HUMAN)
FFLAMPFATPI

SEQ ID NO: 31556 - protein, 11 aa, Artificial Sequence
  Description of Artificial Sequence: Synthetic peptide
  Seed: RASGPGGGAPR (CTG1B_HUMAN)
RSSGPGGGAPY

SEQ ID NO: 31557 - protein, 9 aa, Artificial Sequence
  Description of Artificial Sequence: Synthetic peptide
  Seed: AADHRQLQL (CTG1B_HUMAN)
AYDHRQLQY

SEQ ID NO: 31558 - protein, 11 aa, Artificial Sequence
  Description of Artificial Sequence: Synthetic peptide
  Seed: RASGPGGGAPR (CTG1B_HUMAN)
RPSGPGGGAPL

SEQ ID NO: 31559 - protein, 9 aa, Artificial Sequence
  Description of Artificial Sequence: Synthetic peptide
  Seed: FTVSGNILT (CTG1B_HUMAN)
FVVSGNILL

SEQ ID NO: 31560 - protein, 9 aa, Artificial Sequence
  Description of Artificial Sequence: Synthetic peptide
  Seed: LLMWITQCF (CTG1B_HUMAN)
LKMWITQCF

SEQ ID NO: 31561 - protein, 8 aa, Artificial Sequence
  Description of Artificial Sequence: Synthetic peptide
  Seed: ADHRQLQL (CTG1B_HUMAN)
AEHRQLQF

SEQ ID NO: 31562 - protein, 11 aa, Artificial Sequence
  Description of Artificial Sequence: Synthetic peptide
  Seed: RQLQLSISSCL (CTG1B_HUMAN)
RFLQLSISSCY

SEQ ID NO: 31563 - protein, 9 aa, Artificial Sequence
  Description of Artificial Sequence: Synthetic peptide
  Seed: AARASGPGG (CTG1B_HUMAN)
ASRASGPGG

SEQ ID NO: 31564 - protein, 9 aa, Artificial Sequence
  Description of Artificial Sequence: Synthetic peptide
  Seed: QQLSLLMWI (CTG1B_HUMAN)
QVLSLLMWV

SEQ ID NO: 31565 - protein, 11 aa, Artificial Sequence
  Description of Artificial Sequence: Synthetic peptide
  Seed: AARASGPGGGA (CTG1B_HUMAN)
APRASGPGGGV

SEQ ID NO: 31566 - protein, 10 aa, Artificial Sequence
  Description of Artificial Sequence: Synthetic peptide
  Seed: FTVSGNILTI (CTG1B_HUMAN)
FMVSGNILTV

SEQ ID NO: 31567 - protein, 10 aa, Artificial Sequence
  Description of Artificial Sequence: Synthetic peptide
  Seed: RGPESRLLEF (CTG1B_HUMAN)
RGPESRLLEM

SEQ ID NO: 31568 - protein, 8 aa, Artificial Sequence
  Description of Artificial Sequence: Synthetic peptide
  Seed: RLLEFYLA (CTG1B_HUMAN)
RLLEFYLV

SEQ ID NO: 31569 - protein, 9 aa, Artificial Sequence
  Description of Artificial Sequence: Synthetic peptide
  Seed: SISSCLQQL (CTG1B_HUMAN)
SRSSCLQQV

SEQ ID NO: 31570 - protein, 10 aa, Artificial Sequence
  Description of Artificial Sequence: Synthetic peptide
  Seed: KEFTVSGNIL (CTG1B_HUMAN)
KEFTVSGNIP

SEQ ID NO: 31571 - protein, 10 aa, Artificial Sequence
  Description of Artificial Sequence: Synthetic peptide
  Seed: LLEFYLAMPF (CTG1B_HUMAN)
LKEFYLAMPF

SEQ ID NO: 31572 - protein, 9 aa, Artificial Sequence
  Description of Artificial Sequence: Synthetic peptide
  Seed: QDAPPLPVP (CTG1B_HUMAN)
QEAPPLPVS

SEQ ID NO: 31573 - protein, 9 aa, Artificial Sequence
  Description of Artificial Sequence: Synthetic peptide
  Seed: TPMEAELAR (CTG1B_HUMAN)
TSMEAELAK

SEQ ID NO: 31574 - protein, 9 aa, Artificial Sequence
  Description of Artificial Sequence: Synthetic peptide
  Seed: GPRGAGAAR (CTG1B_HUMAN)
GPRGAGAAM

SEQ ID NO: 31575 - protein, 10 aa, Artificial Sequence
  Description of Artificial Sequence: Synthetic peptide
  Seed: FLAQPPSGQR (CTG1B_HUMAN)
FIAQPPSGQR

SEQ ID NO: 31576 - protein, 10 aa, Artificial Sequence
  Description of Artificial Sequence: Synthetic peptide
  Seed: LLEFYLAMPF (CTG1B_HUMAN)
LIEFYLAMPF

SEQ ID NO: 31577 - protein, 10 aa, Artificial Sequence
  Description of Artificial Sequence: Synthetic peptide
  Seed: SRLLEFYLAM (CTG1B_HUMAN)
SALLEFYLAM

SEQ ID NO: 31578 - protein, 9 aa, Artificial Sequence
  Description of Artificial Sequence: Synthetic peptide
  Seed: AARASGPGG (CTG1B_HUMAN)
ACRASGPGK

SEQ ID NO: 31579 - protein, 9 aa, Artificial Sequence
  Description of Artificial Sequence: Synthetic peptide
  Seed: SLLMWITQC (CTG1B_HUMAN)
STLMWITQL

SEQ ID NO: 31580 - protein, 10 aa, Artificial Sequence
  Description of Artificial Sequence: Synthetic peptide
  Seed: YLAMPFATPM (CTG1B_HUMAN)
YQAMPFATPF

SEQ ID NO: 31581 - protein, 10 aa, Artificial Sequence
  Description of Artificial Sequence: Synthetic peptide
  Seed: RLTAADHRQL (CTG1B_HUMAN)
RVTAADHRQW

SEQ ID NO: 31582 - protein, 9 aa, Artificial Sequence
  Description of Artificial Sequence: Synthetic peptide
  Seed: MPFATPMEA (CTG1B_HUMAN)
MQFATPMEY

SEQ ID NO: 31583 - protein, 10 aa, Artificial Sequence
  Description of Artificial Sequence: Synthetic peptide
  Seed: YLAMPFATPM (CTG1B_HUMAN)
YLAMPFATPA

SEQ ID NO: 31584 - protein, 9 aa, Artificial Sequence
  Description of Artificial Sequence: Synthetic peptide
  Seed: LLMWITQCF (CTG1B_HUMAN)
LWMWITQCI

SEQ ID NO: 31585 - protein, 10 aa, Artificial Sequence
  Description of Artificial Sequence: Synthetic peptide
  Seed: FYLAMPFATP (CTG1B_HUMAN)
FFLAMPFATI

SEQ ID NO: 31586 - protein, 10 aa, Artificial Sequence
  Description of Artificial Sequence: Synthetic peptide
  Seed: FTVSGNILTI (CTG1B_HUMAN)
FMVSGNILTA

SEQ ID NO: 31587 - protein, 11 aa, Artificial Sequence
  Description of Artificial Sequence: Synthetic peptide
  Seed: FYLAMPFATPM (CTG1B_HUMAN)
FWLAMPFATPL

SEQ ID NO: 31588 - protein, 10 aa, Artificial Sequence
  Description of Artificial Sequence: Synthetic peptide
  Seed: GAPRGPHGGA (CTG1B_HUMAN)
GTPRGPHGGL

SEQ ID NO: 31589 - protein, 9 aa, Artificial Sequence
  Description of Artificial Sequence: Synthetic peptide
  Seed: ITQCFLPVF (CTG1B_HUMAN)
IQQCFLPVM

SEQ ID NO: 31590 - protein, 10 aa, Artificial Sequence
  Description of Artificial Sequence: Synthetic peptide
  Seed: LEFYLAMPFA (CTG1B_HUMAN)
LQFYLAMPFD

SEQ ID NO: 31591 - protein, 10 aa, Artificial Sequence
  Description of Artificial Sequence: Synthetic peptide
  Seed: FTVSGNILTI (CTG1B_HUMAN)
FQVSGNILTA

SEQ ID NO: 31592 - protein, 9 aa, Artificial Sequence
  Description of Artificial Sequence: Synthetic peptide
  Seed: AADHRQLQL (CTG1B_HUMAN)
ALDHRQLQY

SEQ ID NO: 31593 - protein, 10 aa, Artificial Sequence
  Description of Artificial Sequence: Synthetic peptide
  Seed: GAPRGPHGGA (CTG1B_HUMAN)
GWPRGPHGGM

SEQ ID NO: 31594 - protein, 10 aa, Artificial Sequence
  Description of Artificial Sequence: Synthetic peptide
  Seed: GAPRGPHGGA (CTG1B_HUMAN)
GGPRGPHGGM

SEQ ID NO: 31595 - protein, 9 aa, Artificial Sequence
  Description of Artificial Sequence: Synthetic peptide
  Seed: LEFYLAMPF (CTG1B_HUMAN)
LVFYLAMPF

SEQ ID NO: 31596 - protein, 11 aa, Artificial Sequence
  Description of Artificial Sequence: Synthetic peptide
  Seed: FYLAMPFATPM (CTG1B_HUMAN)
FPLAMPFATPY

SEQ ID NO: 31597 - protein, 10 aa, Artificial Sequence
  Description of Artificial Sequence: Synthetic peptide
  Seed: SRLLEFYLAM (CTG1B_HUMAN)
SCLLEFYLAM

SEQ ID NO: 31598 - protein, 9 aa, Artificial Sequence
  Description of Artificial Sequence: Synthetic peptide
  Seed: SISSCLQQL (CTG1B_HUMAN)
SLSSCLQQV

SEQ ID NO: 31599 - protein, 10 aa, Artificial Sequence
  Description of Artificial Sequence: Synthetic peptide
  Seed: LSISSCLQQL (CTG1B_HUMAN)
LIISSCLQQW

SEQ ID NO: 31600 - protein, 11 aa, Artificial Sequence
  Description of Artificial Sequence: Synthetic peptide
  Seed: SLLMWITQCFL (CTG1B_HUMAN)
SWLMWITQCFV

SEQ ID NO: 31601 - protein, 9 aa, Artificial Sequence
  Description of Artificial Sequence: Synthetic peptide
  Seed: GARGPESRL (CTG1B_HUMAN)
GPRGPESRL

SEQ ID NO: 31602 - protein, 9 aa, Artificial Sequence
  Description of Artificial Sequence: Synthetic peptide
  Seed: SISSCLQQL (CTG1B_HUMAN)
SISSCLQQW

SEQ ID NO: 31603 - protein, 9 aa, Artificial Sequence
  Description of Artificial Sequence: Synthetic peptide
  Seed: AARASGPGG (CTG1B_HUMAN)
ATRASGPGG

SEQ ID NO: 31604 - protein, 10 aa, Artificial Sequence
  Description of Artificial Sequence: Synthetic peptide
  Seed: AMPFATPMEA (CTG1B_HUMAN)
AVPFATPMEV

SEQ ID NO: 31605 - protein, 10 aa, Artificial Sequence
  Description of Artificial Sequence: Synthetic peptide
  Seed: FLPVFLAQPP (CTG1B_HUMAN)
FAPVFLAQPI

SEQ ID NO: 31606 - protein, 9 aa, Artificial Sequence
  Description of Artificial Sequence: Synthetic peptide
  Seed: LLMWITQCF (CTG1B_HUMAN)
LLMWITQCM

SEQ ID NO: 31607 - protein, 9 aa, Artificial Sequence
  Description of Artificial Sequence: Synthetic peptide
  Seed: RLLEFYLAM (CTG1B_HUMAN)
RKLEFYLAI

SEQ ID NO: 31608 - protein, 11 aa, Artificial Sequence
  Description of Artificial Sequence: Synthetic peptide
  Seed: GEAGATGGRGP (CTG1B_HUMAN)
GEAGATGGRGI

SEQ ID NO: 31609 - protein, 9 aa, Artificial Sequence
  Description of Artificial Sequence: Synthetic peptide
  Seed: KEFTVSGNI (CTG1B_HUMAN)
KEFTVSGNY

SEQ ID NO: 31610 - protein, 9 aa, Artificial Sequence
  Description of Artificial Sequence: Synthetic peptide
  Seed: RQLQLSISS (CTG1B_HUMAN)
RSLQLSISV

SEQ ID NO: 31611 - protein, 10 aa, Artificial Sequence
  Description of Artificial Sequence: Synthetic peptide
  Seed: SRLLEFYLAM (CTG1B_HUMAN)
SNLLEFYLAM

SEQ ID NO: 31612 - protein, 10 aa, Artificial Sequence
  Description of Artificial Sequence: Synthetic peptide
  Seed: AASGLNGCCR (CTG1B_HUMAN)
ATSGLNGCCK

SEQ ID NO: 31613 - protein, 11 aa, Artificial Sequence
  Description of Artificial Sequence: Synthetic peptide
  Seed: EAGATGGRGPR (CTG1B_HUMAN)
EVGATGGRGPR

SEQ ID NO: 31614 - protein, 11 aa, Artificial Sequence
  Description of Artificial Sequence: Synthetic peptide
  Seed: RASGPGGGAPR (CTG1B_HUMAN)
RTSGPGGGAPH

SEQ ID NO: 31615 - protein, 11 aa, Artificial Sequence
  Description of Artificial Sequence: Synthetic peptide
  Seed: LAMPFATPMEA (CTG1B_HUMAN)
LKMPFATPMEA

SEQ ID NO: 31616 - protein, 11 aa, Artificial Sequence
  Description of Artificial Sequence: Synthetic peptide
  Seed: RASGPGGGAPR (CTG1B_HUMAN)
RTSGPGGGAPL

SEQ ID NO: 31617 - protein, 9 aa, Artificial Sequence
  Description of Artificial Sequence: Synthetic peptide
  Seed: SGPGGGAPR (CTG1B_HUMAN)
SRPGGGAPM

SEQ ID NO: 31618 - protein, 9 aa, Artificial Sequence
  Description of Artificial Sequence: Synthetic peptide
  Seed: LLMWITQCF (CTG1B_HUMAN)
LMMWITQCW

SEQ ID NO: 31619 - protein, 9 aa, Artificial Sequence
  Description of Artificial Sequence: Synthetic peptide
  Seed: YLAMPFATP (CTG1B_HUMAN)
YMAMPFATC

SEQ ID NO: 31620 - protein, 10 aa, Artificial Sequence
  Description of Artificial Sequence: Synthetic peptide
  Seed: RLLEFYLAMP (CTG1B_HUMAN)
RYLEFYLAMV

SEQ ID NO: 31621 - protein, 9 aa, Artificial Sequence
  Description of Artificial Sequence: Synthetic peptide
  Seed: FATPMEAEL (CTG1B_HUMAN)
FVTPMEAEY

SEQ ID NO: 31622 - protein, 10 aa, Artificial Sequence
  Description of Artificial Sequence: Synthetic peptide
  Seed: SSCLQQLSLL (CTG1B_HUMAN)
STCLQQLSLF

SEQ ID NO: 31623 - protein, 10 aa, Artificial Sequence
  Description of Artificial Sequence: Synthetic peptide
  Seed: FLPVFLAQPP (CTG1B_HUMAN)
FVPVFLAQPI

SEQ ID NO: 31624 - protein, 9 aa, Artificial Sequence
  Description of Artificial Sequence: Synthetic peptide
  Seed: KEFTVSGNI (CTG1B_HUMAN)
KLFTVSGNI

SEQ ID NO: 31625 - protein, 10 aa, Artificial Sequence
  Description of Artificial Sequence: Synthetic peptide
  Seed: AMPFATPMEA (CTG1B_HUMAN)
AIPFATPMEV

SEQ ID NO: 31626 - protein, 9 aa, Artificial Sequence
  Description of Artificial Sequence: Synthetic peptide
  Seed: LEFYLAMPF (CTG1B_HUMAN)
LRFYLAMPF

SEQ ID NO: 31627 - protein, 9 aa, Artificial Sequence
  Description of Artificial Sequence: Synthetic peptide
  Seed: MPFATPMEA (CTG1B_HUMAN)
MTFATPMEL

SEQ ID NO: 31628 - protein, 9 aa, Artificial Sequence
  Description of Artificial Sequence: Synthetic peptide
  Seed: LQLSISSCL (CTG1B_HUMAN)
LELSISSCF

SEQ ID NO: 31629 - protein, 9 aa, Artificial Sequence
  Description of Artificial Sequence: Synthetic peptide
  Seed: LAMPFATPM (CTG1B_HUMAN)
LIMPFATPA

SEQ ID NO: 31630 - protein, 9 aa, Artificial Sequence
  Description of Artificial Sequence: Synthetic peptide
  Seed: ITQCFLPVF (CTG1B_HUMAN)
IWQCFLPVW

SEQ ID NO: 31631 - protein, 9 aa, Artificial Sequence
  Description of Artificial Sequence: Synthetic peptide
  Seed: MPFATPMEA (CTG1B_HUMAN)
MVFATPMEM

SEQ ID NO: 31632 - protein, 11 aa, Artificial Sequence
  Description of Artificial Sequence: Synthetic peptide
  Seed: RLLEFYLAMPF (CTG1B_HUMAN)
RDLEFYLAMPI

SEQ ID NO: 31633 - protein, 11 aa, Artificial Sequence
  Description of Artificial Sequence: Synthetic peptide
  Seed: RQLQLSISSCL (CTG1B_HUMAN)
RILQLSISSCF

SEQ ID NO: 31634 - protein, 10 aa, Artificial Sequence
  Description of Artificial Sequence: Synthetic peptide
  Seed: RGPHGGAASG (CTG1B_HUMAN)
RLPHGGAASL

SEQ ID NO: 31635 - protein, 10 aa, Artificial Sequence
  Description of Artificial Sequence: Synthetic peptide
  Seed: LLMWITQCFL (CTG1B_HUMAN)
LTMWITQCFI

SEQ ID NO: 31636 - protein, 10 aa, Artificial Sequence
  Description of Artificial Sequence: Synthetic peptide
  Seed: APPLPVPGVL (CTG1B_HUMAN)
AHPLPVPGVL

SEQ ID NO: 31637 - protein, 11 aa, Artificial Sequence
  Description of Artificial Sequence: Synthetic peptide
  Seed: EAGATGGRGPR (CTG1B_HUMAN)
ETGATGGRGPK

SEQ ID NO: 31638 - protein, 11 aa, Artificial Sequence
  Description of Artificial Sequence: Synthetic peptide
  Seed: RASGPGGGAPR (CTG1B_HUMAN)
RTSGPGGGAPK

SEQ ID NO: 31639 - protein, 10 aa, Artificial Sequence
  Description of Artificial Sequence: Synthetic peptide
  Seed: FTVSGNILTI (CTG1B_HUMAN)
FAVSGNILTF

SEQ ID NO: 31640 - protein, 9 aa, Artificial Sequence
  Description of Artificial Sequence: Synthetic peptide
  Seed: LAMPFATPM (CTG1B_HUMAN)
LNMPFATPM

SEQ ID NO: 31641 - protein, 11 aa, Artificial Sequence
  Description of Artificial Sequence: Synthetic peptide
  Seed: RLLEFYLAMPF (CTG1B_HUMAN)
RRLEFYLAMPV

SEQ ID NO: 31642 - protein, 9 aa, Artificial Sequence
  Description of Artificial Sequence: Synthetic peptide
  Seed: TQCFLPVFL (CTG1B_HUMAN)
TVCFLPVFV

SEQ ID NO: 31643 - protein, 10 aa, Artificial Sequence
  Description of Artificial Sequence: Synthetic peptide
  Seed: SRLLEFYLAM (CTG1B_HUMAN)
SVLLEFYLAM

SEQ ID NO: 31644 - protein, 10 aa, Artificial Sequence
  Description of Artificial Sequence: Synthetic peptide
  Seed: LAQPPSGQRR (CTG1B_HUMAN)
LVQPPSGQRR

SEQ ID NO: 31645 - protein, 9 aa, Artificial Sequence
  Description of Artificial Sequence: Synthetic peptide
  Seed: AADHRQLQL (CTG1B_HUMAN)
AVDHRQLQW

SEQ ID NO: 31646 - protein, 10 aa, Artificial Sequence
  Description of Artificial Sequence: Synthetic peptide
  Seed: FYLAMPFATP (CTG1B_HUMAN)
FKLAMPFATL

SEQ ID NO: 31647 - protein, 10 aa, Artificial Sequence
  Description of Artificial Sequence: Synthetic peptide
  Seed: RLTAADHRQL (CTG1B_HUMAN)
RSTAADHRQF

SEQ ID NO: 31648 - protein, 9 aa, Artificial Sequence
  Description of Artificial Sequence: Synthetic peptide
  Seed: SISSCLQQL (CTG1B_HUMAN)
SVSSCLQQV

SEQ ID NO: 31649 - protein, 9 aa, Artificial Sequence
  Description of Artificial Sequence: Synthetic peptide
  Seed: TVSGNILTI (CTG1B_HUMAN)
TFSGNILTM

SEQ ID NO: 31650 - protein, 10 aa, Artificial Sequence
  Description of Artificial Sequence: Synthetic peptide
  Seed: RASGPGGGAP (CTG1B_HUMAN)
RTSGPGGGAY

SEQ ID NO: 31651 - protein, 11 aa, Artificial Sequence
  Description of Artificial Sequence: Synthetic peptide
  Seed: FYLAMPFATPM (CTG1B_HUMAN)
FELAMPFATPM

SEQ ID NO: 31652 - protein, 11 aa, Artificial Sequence
  Description of Artificial Sequence: Synthetic peptide
  Seed: LAMPFATPMEA (CTG1B_HUMAN)
LCMPFATPMEA

SEQ ID NO: 31653 - protein, 9 aa, Artificial Sequence
  Description of Artificial Sequence: Synthetic peptide
  Seed: MQAEGRGTG (CTG1B_HUMAN)
MIAEGRGTF

SEQ ID NO: 31654 - protein, 11 aa, Artificial Sequence
  Description of Artificial Sequence: Synthetic peptide
  Seed: RASGPGGGAPR (CTG1B_HUMAN)
RFSGPGGGAPR

SEQ ID NO: 31655 - protein, 9 aa, Artificial Sequence
  Description of Artificial Sequence: Synthetic peptide
  Seed: ARGPESRLL (CTG1B_HUMAN)
AYGPESRLM

SEQ ID NO: 31656 - protein, 9 aa, Artificial Sequence
  Description of Artificial Sequence: Synthetic peptide
  Seed: SGPGGGAPR (CTG1B_HUMAN)
SAPGGGAPL

SEQ ID NO: 31657 - protein, 9 aa, Artificial Sequence
  Description of Artificial Sequence: Synthetic peptide
  Seed: LAMPFATPM (CTG1B_HUMAN)
LFMPFATPL

SEQ ID NO: 31658 - protein, 9 aa, Artificial Sequence
  Description of Artificial Sequence: Synthetic peptide
  Seed: RLLEFYLAM (CTG1B_HUMAN)
RGLEFYLAW

SEQ ID NO: 31659 - protein, 9 aa, Artificial Sequence
  Description of Artificial Sequence: Synthetic peptide
  Seed: KEFTVSGNI (CTG1B_HUMAN)
KEFTVSGNL

SEQ ID NO: 31660 - protein, 10 aa, Artificial Sequence
  Description of Artificial Sequence: Synthetic peptide
  Seed: SLLMWITQCF (CTG1B_HUMAN)
SMLMWITQCY

SEQ ID NO: 31661 - protein, 10 aa, Artificial Sequence
  Description of Artificial Sequence: Synthetic peptide
  Seed: RLLEFYLAMP (CTG1B_HUMAN)
RFLEFYLAMV

SEQ ID NO: 31662 - protein, 8 aa, Artificial Sequence
  Description of Artificial Sequence: Synthetic peptide
  Seed: ADHRQLQL (CTG1B_HUMAN)
AEHRQLQV

SEQ ID NO: 31663 - protein, 10 aa, Artificial Sequence
  Description of Artificial Sequence: Synthetic peptide
  Seed: RGPHGGAASG (CTG1B_HUMAN)
RIPHGGAASV

SEQ ID NO: 31664 - protein, 9 aa, Artificial Sequence
  Description of Artificial Sequence: Synthetic peptide
  Seed: LAMPFATPM (CTG1B_HUMAN)
LVMPFATPV

SEQ ID NO: 31665 - protein, 9 aa, Artificial Sequence
  Description of Artificial Sequence: Synthetic peptide
  Seed: AARASGPGG (CTG1B_HUMAN)
ASRASGPGT

SEQ ID NO: 31666 - protein, 10 aa, Artificial Sequence
  Description of Artificial Sequence: Synthetic peptide
  Seed: QQLSLLMWIT (CTG1B_HUMAN)
QVLSLLMWIV

SEQ ID NO: 31667 - protein, 10 aa, Artificial Sequence
  Description of Artificial Sequence: Synthetic peptide
  Seed: MWITQCFLPV (CTG1B_HUMAN)
MTITQCFLPA

SEQ ID NO: 31668 - protein, 10 aa, Artificial Sequence
  Description of Artificial Sequence: Synthetic peptide
  Seed: LAQDAPPLPV (CTG1B_HUMAN)
LLQDAPPLPI

SEQ ID NO: 31669 - protein, 10 aa, Artificial Sequence
  Description of Artificial Sequence: Synthetic peptide
  Seed: ISSCLQQLSL (CTG1B_HUMAN)
IVSCLQQLSW

SEQ ID NO: 31670 - protein, 11 aa, Artificial Sequence
  Description of Artificial Sequence: Synthetic peptide
  Seed: FATPMEAELAR (CTG1B_HUMAN)
FATPMEAELAM

SEQ ID NO: 31671 - protein, 9 aa, Artificial Sequence
  Description of Artificial Sequence: Synthetic peptide
  Seed: SISSCLQQL (CTG1B_HUMAN)
STSSCLQQA

SEQ ID NO: 31672 - protein, 9 aa, Artificial Sequence
  Description of Artificial Sequence: Synthetic peptide
  Seed: LLMWITQCF (CTG1B_HUMAN)
LIMWITQCY

SEQ ID NO: 31673 - protein, 9 aa, Artificial Sequence
  Description of Artificial Sequence: Synthetic peptide
  Seed: MPFATPMEA (CTG1B_HUMAN)
MFFATPMEY

SEQ ID NO: 31674 - protein, 11 aa, Artificial Sequence
  Description of Artificial Sequence: Synthetic peptide
  Seed: RASGPGGGAPR (CTG1B_HUMAN)
RQSGPGGGAPF

SEQ ID NO: 31675 - protein, 9 aa, Artificial Sequence
  Description of Artificial Sequence: Synthetic peptide
  Seed: LEFYLAMPF (CTG1B_HUMAN)
LPFYLAMPL

SEQ ID NO: 31676 - protein, 9 aa, Artificial Sequence
  Description of Artificial Sequence: Synthetic peptide
  Seed: MQAEGRGTG (CTG1B_HUMAN)
MMAEGRGTY

SEQ ID NO: 31677 - protein, 10 aa, Artificial Sequence
  Description of Artificial Sequence: Synthetic peptide
  Seed: ASGPGGGAPR (CTG1B_HUMAN)
ATGPGGGAPL

SEQ ID NO: 31678 - protein, 10 aa, Artificial Sequence
  Description of Artificial Sequence: Synthetic peptide
  Seed: YLAMPFATPM (CTG1B_HUMAN)
YAAMPFATPR

SEQ ID NO: 31679 - protein, 9 aa, Artificial Sequence
  Description of Artificial Sequence: Synthetic peptide
  Seed: AADHRQLQL (CTG1B_HUMAN)
AFDHRQLQV

SEQ ID NO: 31680 - protein, 10 aa, Artificial Sequence
  Description of Artificial Sequence: Synthetic peptide
  Seed: KEFTVSGNIL (CTG1B_HUMAN)
KEFTVSGNII

SEQ ID NO: 31681 - protein, 9 aa, Artificial Sequence
  Description of Artificial Sequence: Synthetic peptide
  Seed: TVSGNILTI (CTG1B_HUMAN)
TGSGNILTM

SEQ ID NO: 31682 - protein, 9 aa, Artificial Sequence
  Description of Artificial Sequence: Synthetic peptide
  Seed: LLKEFTVSG (CTG1B_HUMAN)
LIKEFTVSA

SEQ ID NO: 31683 - protein, 11 aa, Artificial Sequence
  Description of Artificial Sequence: Synthetic peptide
  Seed: FYLAMPFATPM (CTG1B_HUMAN)
FKLAMPFATPV

SEQ ID NO: 31684 - protein, 9 aa, Artificial Sequence
  Description of Artificial Sequence: Synthetic peptide
  Seed: FLPVFLAQP (CTG1B_HUMAN)
FVPVFLAQL

SEQ ID NO: 31685 - protein, 9 aa, Artificial Sequence
  Description of Artificial Sequence: Synthetic peptide
  Seed: FATPMEAEL (CTG1B_HUMAN)
FTTPMEAEW

SEQ ID NO: 31686 - protein, 8 aa, Artificial Sequence
  Description of Artificial Sequence: Synthetic peptide
  Seed: EFYLAMPF (CTG1B_HUMAN)
EFYLAMPY

SEQ ID NO: 31687 - protein, 10 aa, Artificial Sequence
  Description of Artificial Sequence: Synthetic peptide
  Seed: LEFYLAMPFA (CTG1B_HUMAN)
LSFYLAMPFY

SEQ ID NO: 31688 - protein, 9 aa, Artificial Sequence
  Description of Artificial Sequence: Synthetic peptide
  Seed: RQLQLSISS (CTG1B_HUMAN)
RILQLSISF

SEQ ID NO: 31689 - protein, 9 aa, Artificial Sequence
  Description of Artificial Sequence: Synthetic peptide
  Seed: LPVPGVLLK (CTG1B_HUMAN)
LIVPGVLLK

SEQ ID NO: 31690 - protein, 9 aa, Artificial Sequence
  Description of Artificial Sequence: Synthetic peptide
  Seed: WITQCFLPV (CTG1B_HUMAN)
WLTQCFLPM

SEQ ID NO: 31691 - protein, 9 aa, Artificial Sequence
  Description of Artificial Sequence: Synthetic peptide
  Seed: AARASGPGG (CTG1B_HUMAN)
AVRASGPGM

SEQ ID NO: 31692 - protein, 9 aa, Artificial Sequence
  Description of Artificial Sequence: Synthetic peptide
  Seed: LEFYLAMPF (CTG1B_HUMAN)
LRFYLAMPL

SEQ ID NO: 31693 - protein, 9 aa, Artificial Sequence
  Description of Artificial Sequence: Synthetic peptide
  Seed: GPESRLLEF (CTG1B_HUMAN)
GPESRLLEM

SEQ ID NO: 31694 - protein, 10 aa, Artificial Sequence
  Description of Artificial Sequence: Synthetic peptide
  Seed: YLAMPFATPM (CTG1B_HUMAN)
YTAMPFATPW

SEQ ID NO: 31695 - protein, 10 aa, Artificial Sequence
  Description of Artificial Sequence: Synthetic peptide
  Seed: YLAMPFATPM (CTG1B_HUMAN)
YEAMPFATPF

SEQ ID NO: 31696 - protein, 9 aa, Artificial Sequence
  Description of Artificial Sequence: Synthetic peptide
  Seed: APPLPVPGV (CTG1B_HUMAN)
ALPLPVPGM

SEQ ID NO: 31697 - protein, 11 aa, Artificial Sequence
  Description of Artificial Sequence: Synthetic peptide
  Seed: SLLMWITQCFL (CTG1B_HUMAN)
SGLMWITQCFV

SEQ ID NO: 31698 - protein, 10 aa, Artificial Sequence
  Description of Artificial Sequence: Synthetic peptide
  Seed: EFTVSGNILT (CTG1B_HUMAN)
ELTVSGNILI

SEQ ID NO: 31699 - protein, 9 aa, Artificial Sequence
  Description of Artificial Sequence: Synthetic peptide
  Seed: SSCLQQLSL (CTG1B_HUMAN)
STCLQQLSM

SEQ ID NO: 31700 - protein, 10 aa, Artificial Sequence
  Description of Artificial Sequence: Synthetic peptide
  Seed: SRLLEFYLAM (CTG1B_HUMAN)
SMLLEFYLAA

SEQ ID NO: 31701 - protein, 11 aa, Artificial Sequence
  Description of Artificial Sequence: Synthetic peptide
  Seed: AARASGPGGGA (CTG1B_HUMAN)
APRASGPGGGL

SEQ ID NO: 31702 - protein, 9 aa, Artificial Sequence
  Description of Artificial Sequence: Synthetic peptide
  Seed: RQLQLSISS (CTG1B_HUMAN)
RELQLSISV

SEQ ID NO: 31703 - protein, 9 aa, Artificial Sequence
  Description of Artificial Sequence: Synthetic peptide
  Seed: TVSGNILTI (CTG1B_HUMAN)
TYSGNILTM

SEQ ID NO: 31704 - protein, 10 aa, Artificial Sequence
  Description of Artificial Sequence: Synthetic peptide
  Seed: FTVSGNILTI (CTG1B_HUMAN)
FIVSGNILTA

SEQ ID NO: 31705 - protein, 9 aa, Artificial Sequence
  Description of Artificial Sequence: Synthetic peptide
  Seed: LAQPPSGQR (CTG1B_HUMAN)
LVQPPSGQM

SEQ ID NO: 31706 - protein, 9 aa, Artificial Sequence
  Description of Artificial Sequence: Synthetic peptide
  Seed: QDAPPLPVP (CTG1B_HUMAN)
QEAPPLPVC

SEQ ID NO: 31707 - protein, 10 aa, Artificial Sequence
  Description of Artificial Sequence: Synthetic peptide
  Seed: TPMEAELARR (CTG1B_HUMAN)
TTMEAELARK

SEQ ID NO: 31708 - protein, 10 aa, Artificial Sequence
  Description of Artificial Sequence: Synthetic peptide
  Seed: GIPDGPGGNA (CTG1B_HUMAN)
GVPDGPGGNF

SEQ ID NO: 31709 - protein, 10 aa, Artificial Sequence
  Description of Artificial Sequence: Synthetic peptide
  Seed: LEFYLAMPFA (CTG1B_HUMAN)
LEFYLAMPFY

SEQ ID NO: 31710 - protein, 9 aa, Artificial Sequence
  Description of Artificial Sequence: Synthetic peptide
  Seed: SISSCLQQL (CTG1B_HUMAN)
STSSCLQQW

SEQ ID NO: 31711 - protein, 9 aa, Artificial Sequence
  Description of Artificial Sequence: Synthetic peptide
  Seed: SGPGGGAPR (CTG1B_HUMAN)
SYPGGGAPY

SEQ ID NO: 31712 - protein, 9 aa, Artificial Sequence
  Description of Artificial Sequence: Synthetic peptide
  Seed: FLPVFLAQP (CTG1B_HUMAN)
FVPVFLAQV

SEQ ID NO: 31713 - protein, 11 aa, Artificial Sequence
  Description of Artificial Sequence: Synthetic peptide
  Seed: LAMPFATPMEA (CTG1B_HUMAN)
LEMPFATPMEA

SEQ ID NO: 31714 - protein, 10 aa, Artificial Sequence
  Description of Artificial Sequence: Synthetic peptide
  Seed: RSLAQDAPPL (CTG1B_HUMAN)
RLLAQDAPPV

SEQ ID NO: 31715 - protein, 9 aa, Artificial Sequence
  Description of Artificial Sequence: Synthetic peptide
  Seed: FLPVFLAQP (CTG1B_HUMAN)
FTPVFLAQA

SEQ ID NO: 31716 - protein, 10 aa, Artificial Sequence
  Description of Artificial Sequence: Synthetic peptide
  Seed: RSLAQDAPPL (CTG1B_HUMAN)
RFLAQDAPPV

SEQ ID NO: 31717 - protein, 10 aa, Artificial Sequence
  Description of Artificial Sequence: Synthetic peptide
  Seed: RLLEFYLAMP (CTG1B_HUMAN)
RVLEFYLAML

SEQ ID NO: 31718 - protein, 9 aa, Artificial Sequence
  Description of Artificial Sequence: Synthetic peptide
  Seed: LLKEFTVSG (CTG1B_HUMAN)
LIKEFTVSV

SEQ ID NO: 31719 - protein, 11 aa, Artificial Sequence
  Description of Artificial Sequence: Synthetic peptide
  Seed: YLAMPFATPME (CTG1B_HUMAN)
YVAMPFATPMV

SEQ ID NO: 31720 - protein, 9 aa, Artificial Sequence
  Description of Artificial Sequence: Synthetic peptide
  Seed: IPDGPGGNA (CTG1B_HUMAN)
IADGPGGNL

SEQ ID NO: 31721 - protein, 9 aa, Artificial Sequence
  Description of Artificial Sequence: Synthetic peptide
  Seed: RLLEFYLAM (CTG1B_HUMAN)
RHLEFYLAM

SEQ ID NO: 31722 - protein, 9 aa, Artificial Sequence
  Description of Artificial Sequence: Synthetic peptide
  Seed: LPVPGVLLK (CTG1B_HUMAN)
LGVPGVLLL

SEQ ID NO: 31723 - protein, 11 aa, Artificial Sequence
  Description of Artificial Sequence: Synthetic peptide
  Seed: RASGPGGGAPR (CTG1B_HUMAN)
RRSGPGGGAPF

SEQ ID NO: 31724 - protein, 9 aa, Artificial Sequence
  Description of Artificial Sequence: Synthetic peptide
  Seed: IPDGPGGNA (CTG1B_HUMAN)
IMDGPGGNL

SEQ ID NO: 31725 - protein, 9 aa, Artificial Sequence
  Description of Artificial Sequence: Synthetic peptide
  Seed: LQLSISSCL (CTG1B_HUMAN)
LVLSISSCL

SEQ ID NO: 31726 - protein, 9 aa, Artificial Sequence
  Description of Artificial Sequence: Synthetic peptide
  Seed: AADHRQLQL (CTG1B_HUMAN)
AWDHRQLQL

SEQ ID NO: 31727 - protein, 10 aa, Artificial Sequence
  Description of Artificial Sequence: Synthetic peptide
  Seed: LLMWITQCFL (CTG1B_HUMAN)
LLMWITQCFA

SEQ ID NO: 31728 - protein, 9 aa, Artificial Sequence
  Description of Artificial Sequence: Synthetic peptide
  Seed: SSCLQQLSL (CTG1B_HUMAN)
SSCLQQLSW

SEQ ID NO: 31729 - protein, 9 aa, Artificial Sequence
  Description of Artificial Sequence: Synthetic peptide
  Seed: WITQCFLPV (CTG1B_HUMAN)
WLTQCFLPI

SEQ ID NO: 31730 - protein, 9 aa, Artificial Sequence
  Description of Artificial Sequence: Synthetic peptide
  Seed: CLQQLSLLM (CTG1B_HUMAN)
CQQQLSLLM

SEQ ID NO: 31731 - protein, 10 aa, Artificial Sequence
  Description of Artificial Sequence: Synthetic peptide
  Seed: SRLLEFYLAM (CTG1B_HUMAN)
SKLLEFYLAA

SEQ ID NO: 31732 - protein, 9 aa, Artificial Sequence
  Description of Artificial Sequence: Synthetic peptide
  Seed: WITQCFLPV (CTG1B_HUMAN)
WLTQCFLPV

SEQ ID NO: 31733 - protein, 10 aa, Artificial Sequence
  Description of Artificial Sequence: Synthetic peptide
  Seed: ASGPGGGAPR (CTG1B_HUMAN)
AAGPGGGAPH

SEQ ID NO: 31734 - protein, 9 aa, Artificial Sequence
  Description of Artificial Sequence: Synthetic peptide
  Seed: LAMPFATPM (CTG1B_HUMAN)
LTMPFATPA

SEQ ID NO: 31735 - protein, 9 aa, Artificial Sequence
  Description of Artificial Sequence: Synthetic peptide
  Seed: SGPGGGAPR (CTG1B_HUMAN)
SYPGGGAPM

SEQ ID NO: 31736 - protein, 10 aa, Artificial Sequence
  Description of Artificial Sequence: Synthetic peptide
  Seed: ITQCFLPVFL (CTG1B_HUMAN)
ILQCFLPVFI

SEQ ID NO: 31737 - protein, 9 aa, Artificial Sequence
  Description of Artificial Sequence: Synthetic peptide
  Seed: AARASGPGG (CTG1B_HUMAN)
AVRASGPGG

SEQ ID NO: 31738 - protein, 10 aa, Artificial Sequence
  Description of Artificial Sequence: Synthetic peptide
  Seed: FTVSGNILTI (CTG1B_HUMAN)
FGVSGNILTV

SEQ ID NO: 31739 - protein, 9 aa, Artificial Sequence
  Description of Artificial Sequence: Synthetic peptide
  Seed: LAMPFATPM (CTG1B_HUMAN)
LWMPFATPF

SEQ ID NO: 31740 - protein, 9 aa, Artificial Sequence
  Description of Artificial Sequence: Synthetic peptide
  Seed: LQLSISSCL (CTG1B_HUMAN)
LVLSISSCI

SEQ ID NO: 31741 - protein, 9 aa, Artificial Sequence
  Description of Artificial Sequence: Synthetic peptide
  Seed: TVSGNILTI (CTG1B_HUMAN)
TSSGNILTF

SEQ ID NO: 31742 - protein, 11 aa, Artificial Sequence
  Description of Artificial Sequence: Synthetic peptide
  Seed: AARASGPGGGA (CTG1B_HUMAN)
AVRASGPGGGF

SEQ ID NO: 31743 - protein, 10 aa, Artificial Sequence
  Description of Artificial Sequence: Synthetic peptide
  Seed: FYLAMPFATP (CTG1B_HUMAN)
FGLAMPFATV

SEQ ID NO: 31744 - protein, 10 aa, Artificial Sequence
  Description of Artificial Sequence: Synthetic peptide
  Seed: YLAMPFATPM (CTG1B_HUMAN)
YNAMPFATPI

SEQ ID NO: 31745 - protein, 10 aa, Artificial Sequence
  Description of Artificial Sequence: Synthetic peptide
  Seed: ASGPGGGAPR (CTG1B_HUMAN)
AAGPGGGAPY

SEQ ID NO: 31746 - protein, 10 aa, Artificial Sequence
  Description of Artificial Sequence: Synthetic peptide
  Seed: FLPVFLAQPP (CTG1B_HUMAN)
FMPVFLAQPV

SEQ ID NO: 31747 - protein, 9 aa, Artificial Sequence
  Description of Artificial Sequence: Synthetic peptide
  Seed: LAQPPSGQR (CTG1B_HUMAN)
LTQPPSGQL

SEQ ID NO: 31748 - protein, 10 aa, Artificial Sequence
  Description of Artificial Sequence: Synthetic peptide
  Seed: FYLAMPFATP (CTG1B_HUMAN)
FLLAMPFATV

SEQ ID NO: 31749 - protein, 11 aa, Artificial Sequence
  Description of Artificial Sequence: Synthetic peptide
  Seed: FYLAMPFATPM (CTG1B_HUMAN)
FDLAMPFATPM

SEQ ID NO: 31750 - protein, 10 aa, Artificial Sequence
  Description of Artificial Sequence: Synthetic peptide
  Seed: FTVSGNILTI (CTG1B_HUMAN)
FMVSGNILTM

SEQ ID NO: 31751 - protein, 9 aa, Artificial Sequence
  Description of Artificial Sequence: Synthetic peptide
  Seed: LPVPGVLLK (CTG1B_HUMAN)
LTVPGVLLR

SEQ ID NO: 31752 - protein, 9 aa, Artificial Sequence
  Description of Artificial Sequence: Synthetic peptide
  Seed: LLMWITQCF (CTG1B_HUMAN)
LWMWITQCF

SEQ ID NO: 31753 - protein, 9 aa, Artificial Sequence
  Description of Artificial Sequence: Synthetic peptide
  Seed: FATPMEAEL (CTG1B_HUMAN)
FITPMEAEF

SEQ ID NO: 31754 - protein, 9 aa, Artificial Sequence
  Description of Artificial Sequence: Synthetic peptide
  Seed: SGNILTIRL (CTG1B_HUMAN)
STNILTIRV

SEQ ID NO: 31755 - protein, 9 aa, Artificial Sequence
  Description of Artificial Sequence: Synthetic peptide
  Seed: RLLEFYLAM (CTG1B_HUMAN)
RQLEFYLAK

SEQ ID NO: 31756 - protein, 9 aa, Artificial Sequence
  Description of Artificial Sequence: Synthetic peptide
  Seed: FATPMEAEL (CTG1B_HUMAN)
FTTPMEAEV

SEQ ID NO: 31757 - protein, 9 aa, Artificial Sequence
  Description of Artificial Sequence: Synthetic peptide
  Seed: LLMWITQCF (CTG1B_HUMAN)
LMMWITQCI

SEQ ID NO: 31758 - protein, 9 aa, Artificial Sequence
  Description of Artificial Sequence: Synthetic peptide
  Seed: SLAQDAPPL (CTG1B_HUMAN)
SAAQDAPPH

SEQ ID NO: 31759 - protein, 11 aa, Artificial Sequence
  Description of Artificial Sequence: Synthetic peptide
  Seed: RQLQLSISSCL (CTG1B_HUMAN)
RRLQLSISSCV

SEQ ID NO: 31760 - protein, 10 aa, Artificial Sequence
  Description of Artificial Sequence: Synthetic peptide
  Seed: MPFATPMEAE (CTG1B_HUMAN)
MTFATPMEAY

SEQ ID NO: 31761 - protein, 9 aa, Artificial Sequence
  Description of Artificial Sequence: Synthetic peptide
  Seed: RLLEFYLAM (CTG1B_HUMAN)
RTLEFYLAH

SEQ ID NO: 31762 - protein, 9 aa, Artificial Sequence
  Description of Artificial Sequence: Synthetic peptide
  Seed: FTVSGNILT (CTG1B_HUMAN)
FMVSGNILV

SEQ ID NO: 31763 - protein, 11 aa, Artificial Sequence
  Description of Artificial Sequence: Synthetic peptide
  Seed: APRGPHGGAAS (CTG1B_HUMAN)
APRGPHGGAAV

SEQ ID NO: 31764 - protein, 9 aa, Artificial Sequence
  Description of Artificial Sequence: Synthetic peptide
  Seed: RQLQLSISS (CTG1B_HUMAN)
RKLQLSISY

SEQ ID NO: 31765 - protein, 10 aa, Artificial Sequence
  Description of Artificial Sequence: Synthetic peptide
  Seed: YLAMPFATPM (CTG1B_HUMAN)
YFAMPFATPV

SEQ ID NO: 31766 - protein, 10 aa, Artificial Sequence
  Description of Artificial Sequence: Synthetic peptide
  Seed: LMWITQCFLP (CTG1B_HUMAN)
LMWITQCFLV

SEQ ID NO: 31767 - protein, 9 aa, Artificial Sequence
  Description of Artificial Sequence: Synthetic peptide
  Seed: SGPGGGAPR (CTG1B_HUMAN)
STPGGGAPM

SEQ ID NO: 31768 - protein, 9 aa, Artificial Sequence
  Description of Artificial Sequence: Synthetic peptide
  Seed: MQAEGRGTG (CTG1B_HUMAN)
MKAEGRGTF

SEQ ID NO: 31769 - protein, 9 aa, Artificial Sequence
  Description of Artificial Sequence: Synthetic peptide
  Seed: SSCLQQLSL (CTG1B_HUMAN)
SACLQQLSV

SEQ ID NO: 31770 - protein, 10 aa, Artificial Sequence
  Description of Artificial Sequence: Synthetic peptide
  Seed: RGPHGGAASG (CTG1B_HUMAN)
RFPHGGAASI

SEQ ID NO: 31771 - protein, 9 aa, Artificial Sequence
  Description of Artificial Sequence: Synthetic peptide
  Seed: IPDGPGGNA (CTG1B_HUMAN)
ISDGPGGNI

SEQ ID NO: 31772 - protein, 9 aa, Artificial Sequence
  Description of Artificial Sequence: Synthetic peptide
  Seed: TVSGNILTI (CTG1B_HUMAN)
TLSGNILTV

SEQ ID NO: 31773 - protein, 9 aa, Artificial Sequence
  Description of Artificial Sequence: Synthetic peptide
  Seed: QQLSLLMWI (CTG1B_HUMAN)
QLLSLLMWA

SEQ ID NO: 31774 - protein, 9 aa, Artificial Sequence
  Description of Artificial Sequence: Synthetic peptide
  Seed: VPGVLLKEF (CTG1B_HUMAN)
VPGVLLKEY

SEQ ID NO: 31775 - protein, 9 aa, Artificial Sequence
  Description of Artificial Sequence: Synthetic peptide
  Seed: AADHRQLQL (CTG1B_HUMAN)
ALDHRQLQV

SEQ ID NO: 31776 - protein, 9 aa, Artificial Sequence
  Description of Artificial Sequence: Synthetic peptide
  Seed: TVSGNILTI (CTG1B_HUMAN)
TISGNILTI

SEQ ID NO: 31777 - protein, 11 aa, Artificial Sequence
  Description of Artificial Sequence: Synthetic peptide
  Seed: GAPRGPHGGAA (CTG1B_HUMAN)
GVPRGPHGGAM

SEQ ID NO: 31778 - protein, 9 aa, Artificial Sequence
  Description of Artificial Sequence: Synthetic peptide
  Seed: MQAEGRGTG (CTG1B_HUMAN)
MQAEGRGTH

SEQ ID NO: 31779 - protein, 10 aa, Artificial Sequence
  Description of Artificial Sequence: Synthetic peptide
  Seed: RGPHGGAASG (CTG1B_HUMAN)
RHPHGGAASM

SEQ ID NO: 31780 - protein, 8 aa, Artificial Sequence
  Description of Artificial Sequence: Synthetic peptide
  Seed: ADHRQLQL (CTG1B_HUMAN)
AEHRQLQL

SEQ ID NO: 31781 - protein, 10 aa, Artificial Sequence
  Description of Artificial Sequence: Synthetic peptide
  Seed: RGPHGGAASG (CTG1B_HUMAN)
REPHGGAASI

SEQ ID NO: 31782 - protein, 10 aa, Artificial Sequence
  Description of Artificial Sequence: Synthetic peptide
  Seed: YLAMPFATPM (CTG1B_HUMAN)
YCAMPFATPV

SEQ ID NO: 31783 - protein, 9 aa, Artificial Sequence
  Description of Artificial Sequence: Synthetic peptide
  Seed: SISSCLQQL (CTG1B_HUMAN)
SMSSCLQQT

SEQ ID NO: 31784 - protein, 9 aa, Artificial Sequence
  Description of Artificial Sequence: Synthetic peptide
  Seed: TPMEAELAR (CTG1B_HUMAN)
TPMEAELAT

SEQ ID NO: 31785 - protein, 9 aa, Artificial Sequence
  Description of Artificial Sequence: Synthetic peptide
  Seed: FTVSGNILT (CTG1B_HUMAN)
FTVSGNILA

SEQ ID NO: 31786 - protein, 9 aa, Artificial Sequence
  Description of Artificial Sequence: Synthetic peptide
  Seed: LEFYLAMPF (CTG1B_HUMAN)
LQFYLAMPL

SEQ ID NO: 31787 - protein, 10 aa, Artificial Sequence
  Description of Artificial Sequence: Synthetic peptide
  Seed: MWITQCFLPV (CTG1B_HUMAN)
MIITQCFLPI

SEQ ID NO: 31788 - protein, 11 aa, Artificial Sequence
  Description of Artificial Sequence: Synthetic peptide
  Seed: GAPRGPHGGAA (CTG1B_HUMAN)
GCPRGPHGGAL

SEQ ID NO: 31789 - protein, 9 aa, Artificial Sequence
  Description of Artificial Sequence: Synthetic peptide
  Seed: QQLSLLMWI (CTG1B_HUMAN)
QRLSLLMWF

SEQ ID NO: 31790 - protein, 10 aa, Artificial Sequence
  Description of Artificial Sequence: Synthetic peptide
  Seed: RLTAADHRQL (CTG1B_HUMAN)
RVTAADHRQF

SEQ ID NO: 31791 - protein, 9 aa, Artificial Sequence
  Description of Artificial Sequence: Synthetic peptide
  Seed: AARASGPGG (CTG1B_HUMAN)
AYRASGPGK

SEQ ID NO: 31792 - protein, 9 aa, Artificial Sequence
  Description of Artificial Sequence: Synthetic peptide
  Seed: WITQCFLPV (CTG1B_HUMAN)
WQTQCFLPA

SEQ ID NO: 31793 - protein, 9 aa, Artificial Sequence
  Description of Artificial Sequence: Synthetic peptide
  Seed: TVSGNILTI (CTG1B_HUMAN)
TQSGNILTV

SEQ ID NO: 31794 - protein, 10 aa, Artificial Sequence
  Description of Artificial Sequence: Synthetic peptide
  Seed: SLLMWITQCF (CTG1B_HUMAN)
SHLMWITQCY

SEQ ID NO: 31795 - protein, 10 aa, Artificial Sequence
  Description of Artificial Sequence: Synthetic peptide
  Seed: MPFATPMEAE (CTG1B_HUMAN)
MMFATPMEAF

SEQ ID NO: 31796 - protein, 10 aa, Artificial Sequence
  Description of Artificial Sequence: Synthetic peptide
  Seed: YLAMPFATPM (CTG1B_HUMAN)
YDAMPFATPY

SEQ ID NO: 31797 - protein, 9 aa, Artificial Sequence
  Description of Artificial Sequence: Synthetic peptide
  Seed: RQLQLSISS (CTG1B_HUMAN)
RHLQLSISY

SEQ ID NO: 31798 - protein, 9 aa, Artificial Sequence
  Description of Artificial Sequence: Synthetic peptide
  Seed: APPLPVPGV (CTG1B_HUMAN)
ATPLPVPGI

SEQ ID NO: 31799 - protein, 10 aa, Artificial Sequence
  Description of Artificial Sequence: Synthetic peptide
  Seed: YLAMPFATPM (CTG1B_HUMAN)
YAAMPFATPI

SEQ ID NO: 31800 - protein, 11 aa, Artificial Sequence
  Description of Artificial Sequence: Synthetic peptide
  Seed: YLAMPFATPME (CTG1B_HUMAN)
YGAMPFATPMV

SEQ ID NO: 31801 - protein, 10 aa, Artificial Sequence
  Description of Artificial Sequence: Synthetic peptide
  Seed: FLPVFLAQPP (CTG1B_HUMAN)
FRPVFLAQPV

SEQ ID NO: 31802 - protein, 10 aa, Artificial Sequence
  Description of Artificial Sequence: Synthetic peptide
  Seed: AMPFATPMEA (CTG1B_HUMAN)
ALPFATPMEA

SEQ ID NO: 31803 - protein, 9 aa, Artificial Sequence
  Description of Artificial Sequence: Synthetic peptide
  Seed: FLPVFLAQP (CTG1B_HUMAN)
FLPVFLAQC

SEQ ID NO: 31804 - protein, 9 aa, Artificial Sequence
  Description of Artificial Sequence: Synthetic peptide
  Seed: LLMWITQCF (CTG1B_HUMAN)
LTMWITQCI

SEQ ID NO: 31805 - protein, 11 aa, Artificial Sequence
  Description of Artificial Sequence: Synthetic peptide
  Seed: GAPRGPHGGAA (CTG1B_HUMAN)
GAPRGPHGGAM

SEQ ID NO: 31806 - protein, 10 aa, Artificial Sequence
  Description of Artificial Sequence: Synthetic peptide
  Seed: FYLAMPFATP (CTG1B_HUMAN)
FYLAMPFATA

SEQ ID NO: 31807 - protein, 10 aa, Artificial Sequence
  Description of Artificial Sequence: Synthetic peptide
  Seed: RGPHGGAASG (CTG1B_HUMAN)
RNPHGGAASL

SEQ ID NO: 31808 - protein, 11 aa, Artificial Sequence
  Description of Artificial Sequence: Synthetic peptide
  Seed: RQLQLSISSCL (CTG1B_HUMAN)
RRLQLSISSCI

SEQ ID NO: 31809 - protein, 9 aa, Artificial Sequence
  Description of Artificial Sequence: Synthetic peptide
  Seed: LAMPFATPM (CTG1B_HUMAN)
LQMPFATPC

SEQ ID NO: 31810 - protein, 10 aa, Artificial Sequence
  Description of Artificial Sequence: Synthetic peptide
  Seed: RGPESRLLEF (CTG1B_HUMAN)
RAPESRLLEM

SEQ ID NO: 31811 - protein, 9 aa, Artificial Sequence
  Description of Artificial Sequence: Synthetic peptide
  Seed: ITQCFLPVF (CTG1B_HUMAN)
ISQCFLPVY

SEQ ID NO: 31812 - protein, 9 aa, Artificial Sequence
  Description of Artificial Sequence: Synthetic peptide
  Seed: RLLEFYLAM (CTG1B_HUMAN)
RLLEFYLAA

SEQ ID NO: 31813 - protein, 10 aa, Artificial Sequence
  Description of Artificial Sequence: Synthetic peptide
  Seed: FYLAMPFATP (CTG1B_HUMAN)
FILAMPFATM

SEQ ID NO: 31814 - protein, 11 aa, Artificial Sequence
  Description of Artificial Sequence: Synthetic peptide
  Seed: RLLEFYLAMPF (CTG1B_HUMAN)
RKLEFYLAMPM

SEQ ID NO: 31815 - protein, 10 aa, Artificial Sequence
  Description of Artificial Sequence: Synthetic peptide
  Seed: ASGPGGGAPR (CTG1B_HUMAN)
ALGPGGGAPR

SEQ ID NO: 31816 - protein, 9 aa, Artificial Sequence
  Description of Artificial Sequence: Synthetic peptide
  Seed: LPVPGVLLK (CTG1B_HUMAN)
LVVPGVLLR

SEQ ID NO: 31817 - protein, 11 aa, Artificial Sequence
  Description of Artificial Sequence: Synthetic peptide
  Seed: RASGPGGGAPR (CTG1B_HUMAN)
RYSGPGGGAPR

SEQ ID NO: 31818 - protein, 9 aa, Artificial Sequence
  Description of Artificial Sequence: Synthetic peptide
  Seed: AARASGPGG (CTG1B_HUMAN)
ANRASGPGK

SEQ ID NO: 31819 - protein, 9 aa, Artificial Sequence
  Description of Artificial Sequence: Synthetic peptide
  Seed: YLAMPFATP (CTG1B_HUMAN)
YAAMPFATA

SEQ ID NO: 31820 - protein, 11 aa, Artificial Sequence
  Description of Artificial Sequence: Synthetic peptide
  Seed: ISSCLQQLSLL (CTG1B_HUMAN)
ISSCLQQLSLY

SEQ ID NO: 31821 - protein, 9 aa, Artificial Sequence
  Description of Artificial Sequence: Synthetic peptide
  Seed: SRLLEFYLA (CTG1B_HUMAN)
SRLLEFYLF

SEQ ID NO: 31822 - protein, 10 aa, Artificial Sequence
  Description of Artificial Sequence: Synthetic peptide
  Seed: ISSCLQQLSL (CTG1B_HUMAN)
INSCLQQLSW

SEQ ID NO: 31823 - protein, 9 aa, Artificial Sequence
  Description of Artificial Sequence: Synthetic peptide
  Seed: TAADHRQLQ (CTG1B_HUMAN)
TVADHRQLY

SEQ ID NO: 31824 - protein, 9 aa, Artificial Sequence
  Description of Artificial Sequence: Synthetic peptide
  Seed: LAMPFATPM (CTG1B_HUMAN)
LPMPFATPC

SEQ ID NO: 31825 - protein, 9 aa, Artificial Sequence
  Description of Artificial Sequence: Synthetic peptide
  Seed: AQDAPPLPV (CTG1B_HUMAN)
AEDAPPLPP

SEQ ID NO: 31826 - protein, 11 aa, Artificial Sequence
  Description of Artificial Sequence: Synthetic peptide
  Seed: GAPRGPHGGAA (CTG1B_HUMAN)
GGPRGPHGGAL

SEQ ID NO: 31827 - protein, 11 aa, Artificial Sequence
  Description of Artificial Sequence: Synthetic peptide
  Seed: RQLQLSISSCL (CTG1B_HUMAN)
RNLQLSISSCF

SEQ ID NO: 31828 - protein, 11 aa, Artificial Sequence
  Description of Artificial Sequence: Synthetic peptide
  Seed: SLLMWITQCFL (CTG1B_HUMAN)
SFLMWITQCFL

SEQ ID NO: 31829 - protein, 10 aa, Artificial Sequence
  Description of Artificial Sequence: Synthetic peptide
  Seed: FTVSGNILTI (CTG1B_HUMAN)
FAVSGNILTA

SEQ ID NO: 31830 - protein, 9 aa, Artificial Sequence
  Description of Artificial Sequence: Synthetic peptide
  Seed: LLKEFTVSG (CTG1B_HUMAN)
LVKEFTVSV

SEQ ID NO: 31831 - protein, 9 aa, Artificial Sequence
  Description of Artificial Sequence: Synthetic peptide
  Seed: FATPMEAEL (CTG1B_HUMAN)
FATPMEAEF

SEQ ID NO: 31832 - protein, 10 aa, Artificial Sequence
  Description of Artificial Sequence: Synthetic peptide
  Seed: FLPVFLAQPP (CTG1B_HUMAN)
FKPVFLAQPI

SEQ ID NO: 31833 - protein, 10 aa, Artificial Sequence
  Description of Artificial Sequence: Synthetic peptide
  Seed: FYLAMPFATP (CTG1B_HUMAN)
FNLAMPFATL

SEQ ID NO: 31834 - protein, 9 aa, Artificial Sequence
  Description of Artificial Sequence: Synthetic peptide
  Seed: LQLSISSCL (CTG1B_HUMAN)
LQLSISSCI

SEQ ID NO: 31835 - protein, 9 aa, Artificial Sequence
  Description of Artificial Sequence: Synthetic peptide
  Seed: VSGNILTIR (CTG1B_HUMAN)
VAGNILTIL

SEQ ID NO: 31836 - protein, 10 aa, Artificial Sequence
  Description of Artificial Sequence: Synthetic peptide
  Seed: RQLQLSISSC (CTG1B_HUMAN)
RQLQLSISSL

SEQ ID NO: 31837 - protein, 10 aa, Artificial Sequence
  Description of Artificial Sequence: Synthetic peptide
  Seed: LLMWITQCFL (CTG1B_HUMAN)
LTMWITQCFL

SEQ ID NO: 31838 - protein, 9 aa, Artificial Sequence
  Description of Artificial Sequence: Synthetic peptide
  Seed: LAMPFATPM (CTG1B_HUMAN)
LKMPFATPI

SEQ ID NO: 31839 - protein, 9 aa, Artificial Sequence
  Description of Artificial Sequence: Synthetic peptide
  Seed: RQLQLSISS (CTG1B_HUMAN)
RVLQLSISF

SEQ ID NO: 31840 - protein, 9 aa, Artificial Sequence
  Description of Artificial Sequence: Synthetic peptide
  Seed: TQCFLPVFL (CTG1B_HUMAN)
TMCFLPVFV

SEQ ID NO: 31841 - protein, 10 aa, Artificial Sequence
  Description of Artificial Sequence: Synthetic peptide
  Seed: SRLLEFYLAM (CTG1B_HUMAN)
SSLLEFYLAM

SEQ ID NO: 31842 - protein, 9 aa, Artificial Sequence
  Description of Artificial Sequence: Synthetic peptide
  Seed: AADHRQLQL (CTG1B_HUMAN)
ADDHRQLQF

SEQ ID NO: 31843 - protein, 11 aa, Artificial Sequence
  Description of Artificial Sequence: Synthetic peptide
  Seed: FYLAMPFATPM (CTG1B_HUMAN)
FHLAMPFATPM

SEQ ID NO: 31844 - protein, 11 aa, Artificial Sequence
  Description of Artificial Sequence: Synthetic peptide
  Seed: LLMWITQCFLP (CTG1B_HUMAN)
LMMWITQCFLV

SEQ ID NO: 31845 - protein, 10 aa, Artificial Sequence
  Description of Artificial Sequence: Synthetic peptide
  Seed: FYLAMPFATP (CTG1B_HUMAN)
FSLAMPFATI

SEQ ID NO: 31846 - protein, 10 aa, Artificial Sequence
  Description of Artificial Sequence: Synthetic peptide
  Seed: FYLAMPFATP (CTG1B_HUMAN)
FSLAMPFATV

SEQ ID NO: 31847 - protein, 9 aa, Artificial Sequence
  Description of Artificial Sequence: Synthetic peptide
  Seed: AADHRQLQL (CTG1B_HUMAN)
AGDHRQLQF

SEQ ID NO: 31848 - protein, 9 aa, Artificial Sequence
  Description of Artificial Sequence: Synthetic peptide
  Seed: FATPMEAEL (CTG1B_HUMAN)
FVTPMEAEW

SEQ ID NO: 31849 - protein, 9 aa, Artificial Sequence
  Description of Artificial Sequence: Synthetic peptide
  Seed: DAPPLPVPG (CTG1B_HUMAN)
DPPPLPVPV

SEQ ID NO: 31850 - protein, 9 aa, Artificial Sequence
  Description of Artificial Sequence: Synthetic peptide
  Seed: TAADHRQLQ (CTG1B_HUMAN)
TLADHRQLF

SEQ ID NO: 31851 - protein, 9 aa, Artificial Sequence
  Description of Artificial Sequence: Synthetic peptide
  Seed: LAMPFATPM (CTG1B_HUMAN)
LLMPFATPT

SEQ ID NO: 31852 - protein, 10 aa, Artificial Sequence
  Description of Artificial Sequence: Synthetic peptide
  Seed: FYLAMPFATP (CTG1B_HUMAN)
FELAMPFATT

SEQ ID NO: 31853 - protein, 9 aa, Artificial Sequence
  Description of Artificial Sequence: Synthetic peptide
  Seed: YLAMPFATP (CTG1B_HUMAN)
YTAMPFATL

SEQ ID NO: 31854 - protein, 9 aa, Artificial Sequence
  Description of Artificial Sequence: Synthetic peptide
  Seed: SSCLQQLSL (CTG1B_HUMAN)
SQCLQQLSL

SEQ ID NO: 31855 - protein, 9 aa, Artificial Sequence
  Description of Artificial Sequence: Synthetic peptide
  Seed: FLPVFLAQP (CTG1B_HUMAN)
FMPVFLAQL

SEQ ID NO: 31856 - protein, 9 aa, Artificial Sequence
  Description of Artificial Sequence: Synthetic peptide
  Seed: FTVSGNILT (CTG1B_HUMAN)
FLVSGNILL

SEQ ID NO: 31857 - protein, 9 aa, Artificial Sequence
  Description of Artificial Sequence: Synthetic peptide
  Seed: KEFTVSGNI (CTG1B_HUMAN)
KQFTVSGNL

SEQ ID NO: 31858 - protein, 10 aa, Artificial Sequence
  Description of Artificial Sequence: Synthetic peptide
  Seed: SRLLEFYLAM (CTG1B_HUMAN)
SLLLEFYLAM

SEQ ID NO: 31859 - protein, 10 aa, Artificial Sequence
  Description of Artificial Sequence: Synthetic peptide
  Seed: FLPVFLAQPP (CTG1B_HUMAN)
FNPVFLAQPA

SEQ ID NO: 31860 - protein, 10 aa, Artificial Sequence
  Description of Artificial Sequence: Synthetic peptide
  Seed: RSLAQDAPPL (CTG1B_HUMAN)
RWLAQDAPPV

SEQ ID NO: 31861 - protein, 9 aa, Artificial Sequence
  Description of Artificial Sequence: Synthetic peptide
  Seed: SGPGGGAPR (CTG1B_HUMAN)
SAPGGGAPY

SEQ ID NO: 31862 - protein, 8 aa, Artificial Sequence
  Description of Artificial Sequence: Synthetic peptide
  Seed: YLAMPFAT (CTG1B_HUMAN)
YLAMPFAA

SEQ ID NO: 31863 - protein, 9 aa, Artificial Sequence
  Description of Artificial Sequence: Synthetic peptide
  Seed: ASGPGGGAP (CTG1B_HUMAN)
ASGPGGGAF

SEQ ID NO: 31864 - protein, 10 aa, Artificial Sequence
  Description of Artificial Sequence: Synthetic peptide
  Seed: LLEFYLAMPF (CTG1B_HUMAN)
LREFYLAMPW

SEQ ID NO: 31865 - protein, 9 aa, Artificial Sequence
  Description of Artificial Sequence: Synthetic peptide
  Seed: AARASGPGG (CTG1B_HUMAN)
AVRASGPGK

SEQ ID NO: 31866 - protein, 10 aa, Artificial Sequence
  Description of Artificial Sequence: Synthetic peptide
  Seed: LLMWITQCFL (CTG1B_HUMAN)
LYMWITQCFI

SEQ ID NO: 31867 - protein, 10 aa, Artificial Sequence
  Description of Artificial Sequence: Synthetic peptide
  Seed: YLAMPFATPM (CTG1B_HUMAN)
YMAMPFATPS

SEQ ID NO: 31868 - protein, 9 aa, Artificial Sequence
  Description of Artificial Sequence: Synthetic peptide
  Seed: LPVFLAQPP (CTG1B_HUMAN)
LAVFLAQPY

SEQ ID NO: 31869 - protein, 10 aa, Artificial Sequence
  Description of Artificial Sequence: Synthetic peptide
  Seed: YLAMPFATPM (CTG1B_HUMAN)
YFAMPFATPW

SEQ ID NO: 31870 - protein, 9 aa, Artificial Sequence
  Description of Artificial Sequence: Synthetic peptide
  Seed: LPVPGVLLK (CTG1B_HUMAN)
LMVPGVLLK

SEQ ID NO: 31871 - protein, 10 aa, Artificial Sequence
  Description of Artificial Sequence: Synthetic peptide
  Seed: FLAQPPSGQR (CTG1B_HUMAN)
FSAQPPSGQM

SEQ ID NO: 31872 - protein, 9 aa, Artificial Sequence
  Description of Artificial Sequence: Synthetic peptide
  Seed: AARASGPGG (CTG1B_HUMAN)
AVRASGPGS

SEQ ID NO: 31873 - protein, 10 aa, Artificial Sequence
  Description of Artificial Sequence: Synthetic peptide
  Seed: LLEFYLAMPF (CTG1B_HUMAN)
LWEFYLAMPF

SEQ ID NO: 31874 - protein, 9 aa, Artificial Sequence
  Description of Artificial Sequence: Synthetic peptide
  Seed: QQLSLLMWI (CTG1B_HUMAN)
QALSLLMWV

SEQ ID NO: 31875 - protein, 9 aa, Artificial Sequence
  Description of Artificial Sequence: Synthetic peptide
  Seed: LQLSISSCL (CTG1B_HUMAN)
LKLSISSCM

SEQ ID NO: 31876 - protein, 9 aa, Artificial Sequence
  Description of Artificial Sequence: Synthetic peptide
  Seed: LAMPFATPM (CTG1B_HUMAN)
LPMPFATPQ

SEQ ID NO: 31877 - protein, 10 aa, Artificial Sequence
  Description of Artificial Sequence: Synthetic peptide
  Seed: MEAELARRSL (CTG1B_HUMAN)
MEAELARRSW

SEQ ID NO: 31878 - protein, 10 aa, Artificial Sequence
  Description of Artificial Sequence: Synthetic peptide
  Seed: RGPESRLLEF (CTG1B_HUMAN)
RNPESRLLEM

SEQ ID NO: 31879 - protein, 9 aa, Artificial Sequence
  Description of Artificial Sequence: Synthetic peptide
  Seed: AQPPSGQRR (CTG1B_HUMAN)
AAPPSGQRV

SEQ ID NO: 31880 - protein, 9 aa, Artificial Sequence
  Description of Artificial Sequence: Synthetic peptide
  Seed: RLLEFYLAM (CTG1B_HUMAN)
RQLEFYLAI

SEQ ID NO: 31881 - protein, 9 aa, Artificial Sequence
  Description of Artificial Sequence: Synthetic peptide
  Seed: RQLQLSISS (CTG1B_HUMAN)
RLLQLSISL

SEQ ID NO: 31882 - protein, 10 aa, Artificial Sequence
  Description of Artificial Sequence: Synthetic peptide
  Seed: ASGPGGGAPR (CTG1B_HUMAN)
AAGPGGGAPK

SEQ ID NO: 31883 - protein, 9 aa, Artificial Sequence
  Description of Artificial Sequence: Synthetic peptide
  Seed: LLMWITQCF (CTG1B_HUMAN)
LQMWITQCF

SEQ ID NO: 31884 - protein, 9 aa, Artificial Sequence
  Description of Artificial Sequence: Synthetic peptide
  Seed: LMWITQCFL (CTG1B_HUMAN)
LQWITQCFM

SEQ ID NO: 31885 - protein, 9 aa, Artificial Sequence
  Description of Artificial Sequence: Synthetic peptide
  Seed: TPMEAELAR (CTG1B_HUMAN)
TAMEAELAK

SEQ ID NO: 31886 - protein, 9 aa, Artificial Sequence
  Description of Artificial Sequence: Synthetic peptide
  Seed: RQLQLSISS (CTG1B_HUMAN)
RMLQLSISV

SEQ ID NO: 31887 - protein, 10 aa, Artificial Sequence
  Description of Artificial Sequence: Synthetic peptide
  Seed: FTVSGNILTI (CTG1B_HUMAN)
FVVSGNILTA

SEQ ID NO: 31888 - protein, 9 aa, Artificial Sequence
  Description of Artificial Sequence: Synthetic peptide
  Seed: SSCLQQLSL (CTG1B_HUMAN)
SACLQQLSY

SEQ ID NO: 31889 - protein, 10 aa, Artificial Sequence
  Description of Artificial Sequence: Synthetic peptide
  Seed: ATPMEAELAR (CTG1B_HUMAN)
ASPMEAELAK

SEQ ID NO: 31890 - protein, 11 aa, Artificial Sequence
  Description of Artificial Sequence: Synthetic peptide
  Seed: RLLEFYLAMPF (CTG1B_HUMAN)
RQLEFYLAMPF

SEQ ID NO: 31891 - protein, 9 aa, Artificial Sequence
  Description of Artificial Sequence: Synthetic peptide
  Seed: SISSCLQQL (CTG1B_HUMAN)
SLSSCLQQL

SEQ ID NO: 31892 - protein, 11 aa, Artificial Sequence
  Description of Artificial Sequence: Synthetic peptide
  Seed: RLLEFYLAMPF (CTG1B_HUMAN)
RPLEFYLAMPF

SEQ ID NO: 31893 - protein, 9 aa, Artificial Sequence
  Description of Artificial Sequence: Synthetic peptide
  Seed: SLLMWITQC (CTG1B_HUMAN)
SMLMWITQV

SEQ ID NO: 31894 - protein, 9 aa, Artificial Sequence
  Description of Artificial Sequence: Synthetic peptide
  Seed: MPFATPMEA (CTG1B_HUMAN)
MLFATPMEM

SEQ ID NO: 31895 - protein, 9 aa, Artificial Sequence
  Description of Artificial Sequence: Synthetic peptide
  Seed: APPLPVPGV (CTG1B_HUMAN)
AIPLPVPGL

SEQ ID NO: 31896 - protein, 9 aa, Artificial Sequence
  Description of Artificial Sequence: Synthetic peptide
  Seed: RQLQLSISS (CTG1B_HUMAN)
RMLQLSISY

SEQ ID NO: 31897 - protein, 10 aa, Artificial Sequence
  Description of Artificial Sequence: Synthetic peptide
  Seed: LEFYLAMPFA (CTG1B_HUMAN)
LRFYLAMPFF

SEQ ID NO: 31898 - protein, 9 aa, Artificial Sequence
  Description of Artificial Sequence: Synthetic peptide
  Seed: ADGPGGPGI (CTG1B_HUMAN)
AEGPGGPGM

SEQ ID NO: 31899 - protein, 9 aa, Artificial Sequence
  Description of Artificial Sequence: Synthetic peptide
  Seed: LAMPFATPM (CTG1B_HUMAN)
LYMPFATPM

SEQ ID NO: 31900 - protein, 9 aa, Artificial Sequence
  Description of Artificial Sequence: Synthetic peptide
  Seed: APPLPVPGV (CTG1B_HUMAN)
AVPLPVPGL

SEQ ID NO: 31901 - protein, 11 aa, Artificial Sequence
  Description of Artificial Sequence: Synthetic peptide
  Seed: RASGPGGGAPR (CTG1B_HUMAN)
RISGPGGGAPR

SEQ ID NO: 31902 - protein, 9 aa, Artificial Sequence
  Description of Artificial Sequence: Synthetic peptide
  Seed: LAQPPSGQR (CTG1B_HUMAN)
LAQPPSGQI

SEQ ID NO: 31903 - protein, 10 aa, Artificial Sequence
  Description of Artificial Sequence: Synthetic peptide
  Seed: AQDAPPLPVP (CTG1B_HUMAN)
AEDAPPLPVL

SEQ ID NO: 31904 - protein, 11 aa, Artificial Sequence
  Description of Artificial Sequence: Synthetic peptide
  Seed: MWITQCFLPVF (CTG1B_HUMAN)
MTITQCFLPVY

SEQ ID NO: 31905 - protein, 9 aa, Artificial Sequence
  Description of Artificial Sequence: Synthetic peptide
  Seed: YLAMPFATP (CTG1B_HUMAN)
YGAMPFATV

SEQ ID NO: 31906 - protein, 9 aa, Artificial Sequence
  Description of Artificial Sequence: Synthetic peptide
  Seed: PPLPVPGVL (CTG1B_HUMAN)
PPLPVPGVA

SEQ ID NO: 31907 - protein, 11 aa, Artificial Sequence
  Description of Artificial Sequence: Synthetic peptide
  Seed: SCLQQLSLLMW (CTG1B_HUMAN)
STLQQLSLLMW

SEQ ID NO: 31908 - protein, 10 aa, Artificial Sequence
  Description of Artificial Sequence: Synthetic peptide
  Seed: AMPFATPMEA (CTG1B_HUMAN)
AYPFATPMEY

SEQ ID NO: 31909 - protein, 10 aa, Artificial Sequence
  Description of Artificial Sequence: Synthetic peptide
  Seed: LLMWITQCFL (CTG1B_HUMAN)
LCMWITQCFV

SEQ ID NO: 31910 - protein, 9 aa, Artificial Sequence
  Description of Artificial Sequence: Synthetic peptide
  Seed: MPFATPMEA (CTG1B_HUMAN)
MVFATPMEA

SEQ ID NO: 31911 - protein, 9 aa, Artificial Sequence
  Description of Artificial Sequence: Synthetic peptide
  Seed: SSCLQQLSL (CTG1B_HUMAN)
SMCLQQLSL

SEQ ID NO: 31912 - protein, 11 aa, Artificial Sequence
  Description of Artificial Sequence: Synthetic peptide
  Seed: RASGPGGGAPR (CTG1B_HUMAN)
RGSGPGGGAPF

SEQ ID NO: 31913 - protein, 9 aa, Artificial Sequence
  Description of Artificial Sequence: Synthetic peptide
  Seed: SGPGGGAPR (CTG1B_HUMAN)
SVPGGGAPF

SEQ ID NO: 31914 - protein, 9 aa, Artificial Sequence
  Description of Artificial Sequence: Synthetic peptide
  Seed: FLPVFLAQP (CTG1B_HUMAN)
FLPVFLAQA

SEQ ID NO: 31915 - protein, 10 aa, Artificial Sequence
  Description of Artificial Sequence: Synthetic peptide
  Seed: LLEFYLAMPF (CTG1B_HUMAN)
LDEFYLAMPM

SEQ ID NO: 31916 - protein, 9 aa, Artificial Sequence
  Description of Artificial Sequence: Synthetic peptide
  Seed: LEFYLAMPF (CTG1B_HUMAN)
LQFYLAMPF

SEQ ID NO: 31917 - protein, 9 aa, Artificial Sequence
  Description of Artificial Sequence: Synthetic peptide
  Seed: WITQCFLPV (CTG1B_HUMAN)
WMTQCFLPA

SEQ ID NO: 31918 - protein, 10 aa, Artificial Sequence
  Description of Artificial Sequence: Synthetic peptide
  Seed: LAQDAPPLPV (CTG1B_HUMAN)
LVQDAPPLPV

SEQ ID NO: 31919 - protein, 10 aa, Artificial Sequence
  Description of Artificial Sequence: Synthetic peptide
  Seed: RGPHGGAASG (CTG1B_HUMAN)
REPHGGAASA

SEQ ID NO: 31920 - protein, 9 aa, Artificial Sequence
  Description of Artificial Sequence: Synthetic peptide
  Seed: RQLQLSISS (CTG1B_HUMAN)
RHLQLSISM

SEQ ID NO: 31921 - protein, 9 aa, Artificial Sequence
  Description of Artificial Sequence: Synthetic peptide
  Seed: SGPGGGAPR (CTG1B_HUMAN)
SSPGGGAPR

SEQ ID NO: 31922 - protein, 9 aa, Artificial Sequence
  Description of Artificial Sequence: Synthetic peptide
  Seed: LEFYLAMPF (CTG1B_HUMAN)
LEFYLAMPP

SEQ ID NO: 31923 - protein, 11 aa, Artificial Sequence
  Description of Artificial Sequence: Synthetic peptide
  Seed: RGPHGGAASGL (CTG1B_HUMAN)
RAPHGGAASGL

SEQ ID NO: 31924 - protein, 10 aa, Artificial Sequence
  Description of Artificial Sequence: Synthetic peptide
  Seed: SRLLEFYLAM (CTG1B_HUMAN)
SWLLEFYLAL

SEQ ID NO: 31925 - protein, 9 aa, Artificial Sequence
  Description of Artificial Sequence: Synthetic peptide
  Seed: SGNILTIRL (CTG1B_HUMAN)
STNILTIRL

SEQ ID NO: 31926 - protein, 9 aa, Artificial Sequence
  Description of Artificial Sequence: Synthetic peptide
  Seed: TQCFLPVFL (CTG1B_HUMAN)
THCFLPVFL

SEQ ID NO: 31927 - protein, 9 aa, Artificial Sequence
  Description of Artificial Sequence: Synthetic peptide
  Seed: AARASGPGG (CTG1B_HUMAN)
ATRASGPGP

SEQ ID NO: 31928 - protein, 11 aa, Artificial Sequence
  Description of Artificial Sequence: Synthetic peptide
  Seed: RLLEFYLAMPF (CTG1B_HUMAN)
RVLEFYLAMPF

SEQ ID NO: 31929 - protein, 9 aa, Artificial Sequence
  Description of Artificial Sequence: Synthetic peptide
  Seed: LLMWITQCF (CTG1B_HUMAN)
LLMWITQCA

SEQ ID NO: 31930 - protein, 9 aa, Artificial Sequence
  Description of Artificial Sequence: Synthetic peptide
  Seed: SLAQDAPPL (CTG1B_HUMAN)
SQAQDAPPL

SEQ ID NO: 31931 - protein, 11 aa, Artificial Sequence
  Description of Artificial Sequence: Synthetic peptide
  Seed: AEGRGTGGSTG (CTG1B_HUMAN)
AEGRGTGGSTM

SEQ ID NO: 31932 - protein, 9 aa, Artificial Sequence
  Description of Artificial Sequence: Synthetic peptide
  Seed: SISSCLQQL (CTG1B_HUMAN)
SQSSCLQQY

SEQ ID NO: 31933 - protein, 10 aa, Artificial Sequence
  Description of Artificial Sequence: Synthetic peptide
  Seed: LLEFYLAMPF (CTG1B_HUMAN)
LREFYLAMPI

SEQ ID NO: 31934 - protein, 9 aa, Artificial Sequence
  Description of Artificial Sequence: Synthetic peptide
  Seed: SGPGGGAPR (CTG1B_HUMAN)
SLPGGGAPM

SEQ ID NO: 31935 - protein, 9 aa, Artificial Sequence
  Description of Artificial Sequence: Synthetic peptide
  Seed: MQAEGRGTG (CTG1B_HUMAN)
MRAEGRGTM

SEQ ID NO: 31936 - protein, 9 aa, Artificial Sequence
  Description of Artificial Sequence: Synthetic peptide
  Seed: AADHRQLQL (CTG1B_HUMAN)
AQDHRQLQF

SEQ ID NO: 31937 - protein, 9 aa, Artificial Sequence
  Description of Artificial Sequence: Synthetic peptide
  Seed: TQCFLPVFL (CTG1B_HUMAN)
TICFLPVFL

SEQ ID NO: 31938 - protein, 10 aa, Artificial Sequence
  Description of Artificial Sequence: Synthetic peptide
  Seed: TPMEAELARR (CTG1B_HUMAN)
TIMEAELARK

SEQ ID NO: 31939 - protein, 11 aa, Artificial Sequence
  Description of Artificial Sequence: Synthetic peptide
  Seed: RQLQLSISSCL (CTG1B_HUMAN)
RELQLSISSCY

SEQ ID NO: 31940 - protein, 10 aa, Artificial Sequence
  Description of Artificial Sequence: Synthetic peptide
  Seed: FLPVFLAQPP (CTG1B_HUMAN)
FEPVFLAQPV

SEQ ID NO: 31941 - protein, 10 aa, Artificial Sequence
  Description of Artificial Sequence: Synthetic peptide
  Seed: LLMWITQCFL (CTG1B_HUMAN)
LMMWITQCFV

SEQ ID NO: 31942 - protein, 10 aa, Artificial Sequence
  Description of Artificial Sequence: Synthetic peptide
  Seed: ATPMEAELAR (CTG1B_HUMAN)
AVPMEAELAK

SEQ ID NO: 31943 - protein, 9 aa, Artificial Sequence
  Description of Artificial Sequence: Synthetic peptide
  Seed: LEFYLAMPF (CTG1B_HUMAN)
LDFYLAMPL

SEQ ID NO: 31944 - protein, 9 aa, Artificial Sequence
  Description of Artificial Sequence: Synthetic peptide
  Seed: MQAEGRGTG (CTG1B_HUMAN)
MAAEGRGTF

SEQ ID NO: 31945 - protein, 10 aa, Artificial Sequence
  Description of Artificial Sequence: Synthetic peptide
  Seed: YLAMPFATPM (CTG1B_HUMAN)
YKAMPFATPW

SEQ ID NO: 31946 - protein, 10 aa, Artificial Sequence
  Description of Artificial Sequence: Synthetic peptide
  Seed: SRLLEFYLAM (CTG1B_HUMAN)
SGLLEFYLAY

SEQ ID NO: 31947 - protein, 10 aa, Artificial Sequence
  Description of Artificial Sequence: Synthetic peptide
  Seed: RGPHGGAASG (CTG1B_HUMAN)
RMPHGGAASI

SEQ ID NO: 31948 - protein, 9 aa, Artificial Sequence
  Description of Artificial Sequence: Synthetic peptide
  Seed: SLAQDAPPL (CTG1B_HUMAN)
SQAQDAPPF

SEQ ID NO: 31949 - protein, 11 aa, Artificial Sequence
  Description of Artificial Sequence: Synthetic peptide
  Seed: FYLAMPFATPM (CTG1B_HUMAN)
FILAMPFATPM

SEQ ID NO: 31950 - protein, 9 aa, Artificial Sequence
  Description of Artificial Sequence: Synthetic peptide
  Seed: LMWITQCFL (CTG1B_HUMAN)
LSWITQCFY

SEQ ID NO: 31951 - protein, 9 aa, Artificial Sequence
  Description of Artificial Sequence: Synthetic peptide
  Seed: FATPMEAEL (CTG1B_HUMAN)
FMTPMEAEM

SEQ ID NO: 31952 - protein, 11 aa, Artificial Sequence
  Description of Artificial Sequence: Synthetic peptide
  Seed: RLLEFYLAMPF (CTG1B_HUMAN)
RQLEFYLAMPV

SEQ ID NO: 31953 - protein, 10 aa, Artificial Sequence
  Description of Artificial Sequence: Synthetic peptide
  Seed: FTVSGNILTI (CTG1B_HUMAN)
FVVSGNILTV

SEQ ID NO: 31954 - protein, 9 aa, Artificial Sequence
  Description of Artificial Sequence: Synthetic peptide
  Seed: RLLEFYLAM (CTG1B_HUMAN)
RYLEFYLAY

SEQ ID NO: 31955 - protein, 10 aa, Artificial Sequence
  Description of Artificial Sequence: Synthetic peptide
  Seed: YLAMPFATPM (CTG1B_HUMAN)
YIAMPFATPM

SEQ ID NO: 31956 - protein, 10 aa, Artificial Sequence
  Description of Artificial Sequence: Synthetic peptide
  Seed: RASGPGGGAP (CTG1B_HUMAN)
RPSGPGGGAV

SEQ ID NO: 31957 - protein, 10 aa, Artificial Sequence
  Description of Artificial Sequence: Synthetic peptide
  Seed: MWITQCFLPV (CTG1B_HUMAN)
MMITQCFLPI

SEQ ID NO: 31958 - protein, 9 aa, Artificial Sequence
  Description of Artificial Sequence: Synthetic peptide
  Seed: TAADHRQLQ (CTG1B_HUMAN)
TSADHRQLY

SEQ ID NO: 31959 - protein, 9 aa, Artificial Sequence
  Description of Artificial Sequence: Synthetic peptide
  Seed: LAMPFATPM (CTG1B_HUMAN)
LSMPFATPY

SEQ ID NO: 31960 - protein, 9 aa, Artificial Sequence
  Description of Artificial Sequence: Synthetic peptide
  Seed: TAADHRQLQ (CTG1B_HUMAN)
TTADHRQLY

SEQ ID NO: 31961 - protein, 10 aa, Artificial Sequence
  Description of Artificial Sequence: Synthetic peptide
  Seed: RASGPGGGAP (CTG1B_HUMAN)
RASGPGGGAL

SEQ ID NO: 31962 - protein, 9 aa, Artificial Sequence
  Description of Artificial Sequence: Synthetic peptide
  Seed: APRGPHGGA (CTG1B_HUMAN)
AARGPHGGM

SEQ ID NO: 31963 - protein, 9 aa, Artificial Sequence
  Description of Artificial Sequence: Synthetic peptide
  Seed: RLLEFYLAM (CTG1B_HUMAN)
RKLEFYLAM

SEQ ID NO: 31964 - protein, 9 aa, Artificial Sequence
  Description of Artificial Sequence: Synthetic peptide
  Seed: AQDAPPLPV (CTG1B_HUMAN)
AYDAPPLPY

SEQ ID NO: 31965 - protein, 9 aa, Artificial Sequence
  Description of Artificial Sequence: Synthetic peptide
  Seed: GPGEAGATG (CTG1B_HUMAN)
GPGEAGATA

SEQ ID NO: 31966 - protein, 9 aa, Artificial Sequence
  Description of Artificial Sequence: Synthetic peptide
  Seed: RQLQLSISS (CTG1B_HUMAN)
RQLQLSISL

SEQ ID NO: 31967 - protein, 11 aa, Artificial Sequence
  Description of Artificial Sequence: Synthetic peptide
  Seed: YLAMPFATPME (CTG1B_HUMAN)
YAAMPFATPMF

SEQ ID NO: 31968 - protein, 9 aa, Artificial Sequence
  Description of Artificial Sequence: Synthetic peptide
  Seed: ADGPGGPGI (CTG1B_HUMAN)
AEGPGGPGC

SEQ ID NO: 31969 - protein, 10 aa, Artificial Sequence
  Description of Artificial Sequence: Synthetic peptide
  Seed: FLPVFLAQPP (CTG1B_HUMAN)
FEPVFLAQPI

SEQ ID NO: 31970 - protein, 10 aa, Artificial Sequence
  Description of Artificial Sequence: Synthetic peptide
  Seed: LLEFYLAMPF (CTG1B_HUMAN)
LSEFYLAMPY

SEQ ID NO: 31971 - protein, 10 aa, Artificial Sequence
  Description of Artificial Sequence: Synthetic peptide
  Seed: FTVSGNILTI (CTG1B_HUMAN)
FQVSGNILTI

SEQ ID NO: 31972 - protein, 10 aa, Artificial Sequence
  Description of Artificial Sequence: Synthetic peptide
  Seed: YLAMPFATPM (CTG1B_HUMAN)
YWAMPFATPY

SEQ ID NO: 31973 - protein, 11 aa, Artificial Sequence
  Description of Artificial Sequence: Synthetic peptide
  Seed: LPVPGVLLKEF (CTG1B_HUMAN)
LPVPGVLLKEY

SEQ ID NO: 31974 - protein, 11 aa, Artificial Sequence
  Description of Artificial Sequence: Synthetic peptide
  Seed: RQLQLSISSCL (CTG1B_HUMAN)
RMLQLSISSCY

SEQ ID NO: 31975 - protein, 10 aa, Artificial Sequence
  Description of Artificial Sequence: Synthetic peptide
  Seed: LLEFYLAMPF (CTG1B_HUMAN)
LFEFYLAMPY

SEQ ID NO: 31976 - protein, 11 aa, Artificial Sequence
  Description of Artificial Sequence: Synthetic peptide
  Seed: FYLAMPFATPM (CTG1B_HUMAN)
FTLAMPFATPM

SEQ ID NO: 31977 - protein, 10 aa, Artificial Sequence
  Description of Artificial Sequence: Synthetic peptide
  Seed: RGPRGAGAAR (CTG1B_HUMAN)
RLPRGAGAAR

SEQ ID NO: 31978 - protein, 10 aa, Artificial Sequence
  Description of Artificial Sequence: Synthetic peptide
  Seed: SRLLEFYLAM (CTG1B_HUMAN)
SILLEFYLAY

SEQ ID NO: 31979 - protein, 10 aa, Artificial Sequence
  Description of Artificial Sequence: Synthetic peptide
  Seed: YLAMPFATPM (CTG1B_HUMAN)
YKAMPFATPY

SEQ ID NO: 31980 - protein, 9 aa, Artificial Sequence
  Description of Artificial Sequence: Synthetic peptide
  Seed: SGPGGGAPR (CTG1B_HUMAN)
SAPGGGAPF

SEQ ID NO: 31981 - protein, 9 aa, Artificial Sequence
  Description of Artificial Sequence: Synthetic peptide
  Seed: MQAEGRGTG (CTG1B_HUMAN)
MMAEGRGTL

SEQ ID NO: 31982 - protein, 10 aa, Artificial Sequence
  Description of Artificial Sequence: Synthetic peptide
  Seed: ASGPGGGAPR (CTG1B_HUMAN)
ATGPGGGAPY

SEQ ID NO: 31983 - protein, 9 aa, Artificial Sequence
  Description of Artificial Sequence: Synthetic peptide
  Seed: SGPGGGAPR (CTG1B_HUMAN)
SVPGGGAPK

SEQ ID NO: 31984 - protein, 9 aa, Artificial Sequence
  Description of Artificial Sequence: Synthetic peptide
  Seed: TVSGNILTI (CTG1B_HUMAN)
TLSGNILTT

SEQ ID NO: 31985 - protein, 10 aa, Artificial Sequence
  Description of Artificial Sequence: Synthetic peptide
  Seed: ITQCFLPVFL (CTG1B_HUMAN)
ITQCFLPVFW

SEQ ID NO: 31986 - protein, 9 aa, Artificial Sequence
  Description of Artificial Sequence: Synthetic peptide
  Seed: LLMWITQCF (CTG1B_HUMAN)
LTMWITQCW

SEQ ID NO: 31987 - protein, 10 aa, Artificial Sequence
  Description of Artificial Sequence: Synthetic peptide
  Seed: RLTAADHRQL (CTG1B_HUMAN)
RGTAADHRQF

SEQ ID NO: 31988 - protein, 10 aa, Artificial Sequence
  Description of Artificial Sequence: Synthetic peptide
  Seed: LSISSCLQQL (CTG1B_HUMAN)
LIISSCLQQI

SEQ ID NO: 31989 - protein, 10 aa, Artificial Sequence
  Description of Artificial Sequence: Synthetic peptide
  Seed: SRLLEFYLAM (CTG1B_HUMAN)
SLLLEFYLAV

SEQ ID NO: 31990 - protein, 9 aa, Artificial Sequence
  Description of Artificial Sequence: Synthetic peptide
  Seed: LEFYLAMPF (CTG1B_HUMAN)
LQFYLAMPY

SEQ ID NO: 31991 - protein, 9 aa, Artificial Sequence
  Description of Artificial Sequence: Synthetic peptide
  Seed: ITQCFLPVF (CTG1B_HUMAN)
ILQCFLPVY

SEQ ID NO: 31992 - protein, 9 aa, Artificial Sequence
  Description of Artificial Sequence: Synthetic peptide
  Seed: LAMPFATPM (CTG1B_HUMAN)
LLMPFATPA

SEQ ID NO: 31993 - protein, 10 aa, Artificial Sequence
  Description of Artificial Sequence: Synthetic peptide
  Seed: RLTAADHRQL (CTG1B_HUMAN)
RPTAADHRQF

SEQ ID NO: 31994 - protein, 9 aa, Artificial Sequence
  Description of Artificial Sequence: Synthetic peptide
  Seed: FATPMEAEL (CTG1B_HUMAN)
FRTPMEAEF

SEQ ID NO: 31995 - protein, 9 aa, Artificial Sequence
  Description of Artificial Sequence: Synthetic peptide
  Seed: LAMPFATPM (CTG1B_HUMAN)
LHMPFATPW

SEQ ID NO: 31996 - protein, 9 aa, Artificial Sequence
  Description of Artificial Sequence: Synthetic peptide
  Seed: LAQPPSGQR (CTG1B_HUMAN)
LVQPPSGQY

SEQ ID NO: 31997 - protein, 11 aa, Artificial Sequence
  Description of Artificial Sequence: Synthetic peptide
  Seed: FYLAMPFATPM (CTG1B_HUMAN)
FVLAMPFATPM

SEQ ID NO: 31998 - protein, 9 aa, Artificial Sequence
  Description of Artificial Sequence: Synthetic peptide
  Seed: LEFYLAMPF (CTG1B_HUMAN)
LCFYLAMPY

SEQ ID NO: 31999 - protein, 9 aa, Artificial Sequence
  Description of Artificial Sequence: Synthetic peptide
  Seed: TVSGNILTI (CTG1B_HUMAN)
TASGNILTH

SEQ ID NO: 32000 - protein, 10 aa, Artificial Sequence
  Description of Artificial Sequence: Synthetic peptide
  Seed: EFTVSGNILT (CTG1B_HUMAN)
ECTVSGNILV

SEQ ID NO: 32001 - protein, 10 aa, Artificial Sequence
  Description of Artificial Sequence: Synthetic peptide
  Seed: YLAMPFATPM (CTG1B_HUMAN)
YCAMPFATPM

SEQ ID NO: 32002 - protein, 9 aa, Artificial Sequence
  Description of Artificial Sequence: Synthetic peptide
  Seed: SGNILTIRL (CTG1B_HUMAN)
SANILTIRY

SEQ ID NO: 32003 - protein, 9 aa, Artificial Sequence
  Description of Artificial Sequence: Synthetic peptide
  Seed: SGPGGGAPR (CTG1B_HUMAN)
SAPGGGAPR

SEQ ID NO: 32004 - protein, 9 aa, Artificial Sequence
  Description of Artificial Sequence: Synthetic peptide
  Seed: AARASGPGG (CTG1B_HUMAN)
ASRASGPGA

SEQ ID NO: 32005 - protein, 9 aa, Artificial Sequence
  Description of Artificial Sequence: Synthetic peptide
  Seed: YLAMPFATP (CTG1B_HUMAN)
YIAMPFATI

SEQ ID NO: 32006 - protein, 9 aa, Artificial Sequence
  Description of Artificial Sequence: Synthetic peptide
  Seed: SISSCLQQL (CTG1B_HUMAN)
STSSCLQQM

SEQ ID NO: 32007 - protein, 11 aa, Artificial Sequence
  Description of Artificial Sequence: Synthetic peptide
  Seed: FTVSGNILTIR (CTG1B_HUMAN)
FVVSGNILTIR

SEQ ID NO: 32008 - protein, 10 aa, Artificial Sequence
  Description of Artificial Sequence: Synthetic peptide
  Seed: YLAMPFATPM (CTG1B_HUMAN)
YEAMPFATPI

SEQ ID NO: 32009 - protein, 10 aa, Artificial Sequence
  Description of Artificial Sequence: Synthetic peptide
  Seed: GAPRGPHGGA (CTG1B_HUMAN)
GNPRGPHGGM

SEQ ID NO: 32010 - protein, 10 aa, Artificial Sequence
  Description of Artificial Sequence: Synthetic peptide
  Seed: ITQCFLPVFL (CTG1B_HUMAN)
IMQCFLPVFA

SEQ ID NO: 32011 - protein, 9 aa, Artificial Sequence
  Description of Artificial Sequence: Synthetic peptide
  Seed: MQAEGRGTG (CTG1B_HUMAN)
MIAEGRGTY

SEQ ID NO: 32012 - protein, 9 aa, Artificial Sequence
  Description of Artificial Sequence: Synthetic peptide
  Seed: MPFATPMEA (CTG1B_HUMAN)
MPFATPMED

SEQ ID NO: 32013 - protein, 11 aa, Artificial Sequence
  Description of Artificial Sequence: Synthetic peptide
  Seed: FYLAMPFATPM (CTG1B_HUMAN)
FHLAMPFATPF

SEQ ID NO: 32014 - protein, 10 aa, Artificial Sequence
  Description of Artificial Sequence: Synthetic peptide
  Seed: TVSGNILTIR (CTG1B_HUMAN)
TTSGNILTIY

SEQ ID NO: 32015 - protein, 9 aa, Artificial Sequence
  Description of Artificial Sequence: Synthetic peptide
  Seed: TQCFLPVFL (CTG1B_HUMAN)
TQCFLPVFY

SEQ ID NO: 32016 - protein, 10 aa, Artificial Sequence
  Description of Artificial Sequence: Synthetic peptide
  Seed: SRLLEFYLAM (CTG1B_HUMAN)
SQLLEFYLAL

SEQ ID NO: 32017 - protein, 9 aa, Artificial Sequence
  Description of Artificial Sequence: Synthetic peptide
  Seed: MQAEGRGTG (CTG1B_HUMAN)
MLAEGRGTF

SEQ ID NO: 32018 - protein, 10 aa, Artificial Sequence
  Description of Artificial Sequence: Synthetic peptide
  Seed: KEFTVSGNIL (CTG1B_HUMAN)
KRFTVSGNIY

SEQ ID NO: 32019 - protein, 10 aa, Artificial Sequence
  Description of Artificial Sequence: Synthetic peptide
  Seed: RGPESRLLEF (CTG1B_HUMAN)
RSPESRLLEW

SEQ ID NO: 32020 - protein, 9 aa, Artificial Sequence
  Description of Artificial Sequence: Synthetic peptide
  Seed: RLLEFYLAM (CTG1B_HUMAN)
RALEFYLAM

SEQ ID NO: 32021 - protein, 9 aa, Artificial Sequence
  Description of Artificial Sequence: Synthetic peptide
  Seed: AADHRQLQL (CTG1B_HUMAN)
AYDHRQLQI

SEQ ID NO: 32022 - protein, 11 aa, Artificial Sequence
  Description of Artificial Sequence: Synthetic peptide
  Seed: GPRGAGAARAS (CTG1B_HUMAN)
GPRGAGAARAV

SEQ ID NO: 32023 - protein, 10 aa, Artificial Sequence
  Description of Artificial Sequence: Synthetic peptide
  Seed: LLMWITQCFL (CTG1B_HUMAN)
LYMWITQCFV

SEQ ID NO: 32024 - protein, 10 aa, Artificial Sequence
  Description of Artificial Sequence: Synthetic peptide
  Seed: MWITQCFLPV (CTG1B_HUMAN)
MYITQCFLPF

SEQ ID NO: 32025 - protein, 10 aa, Artificial Sequence
  Description of Artificial Sequence: Synthetic peptide
  Seed: FLAQPPSGQR (CTG1B_HUMAN)
FAAQPPSGQF

SEQ ID NO: 32026 - protein, 9 aa, Artificial Sequence
  Description of Artificial Sequence: Synthetic peptide
  Seed: LQQLSLLMW (CTG1B_HUMAN)
LAQLSLLMW

SEQ ID NO: 32027 - protein, 9 aa, Artificial Sequence
  Description of Artificial Sequence: Synthetic peptide
  Seed: MQAEGRGTG (CTG1B_HUMAN)
MVAEGRGTF

SEQ ID NO: 32028 - protein, 10 aa, Artificial Sequence
  Description of Artificial Sequence: Synthetic peptide
  Seed: EFTVSGNILT (CTG1B_HUMAN)
EITVSGNILI

SEQ ID NO: 32029 - protein, 10 aa, Artificial Sequence
  Description of Artificial Sequence: Synthetic peptide
  Seed: YLAMPFATPM (CTG1B_HUMAN)
YQAMPFATPM

SEQ ID NO: 32030 - protein, 10 aa, Artificial Sequence
  Description of Artificial Sequence: Synthetic peptide
  Seed: FLAQPPSGQR (CTG1B_HUMAN)
FSAQPPSGQR

SEQ ID NO: 32031 - protein, 9 aa, Artificial Sequence
  Description of Artificial Sequence: Synthetic peptide
  Seed: AADHRQLQL (CTG1B_HUMAN)
AEDHRQLQI

SEQ ID NO: 32032 - protein, 10 aa, Artificial Sequence
  Description of Artificial Sequence: Synthetic peptide
  Seed: LSISSCLQQL (CTG1B_HUMAN)
LAISSCLQQV

SEQ ID NO: 32033 - protein, 8 aa, Artificial Sequence
  Description of Artificial Sequence: Synthetic peptide
  Seed: ATPMEAEL (CTG1B_HUMAN)
AAPMEAEL

SEQ ID NO: 32034 - protein, 9 aa, Artificial Sequence
  Description of Artificial Sequence: Synthetic peptide
  Seed: LAQPPSGQR (CTG1B_HUMAN)
LMQPPSGQK

SEQ ID NO: 32035 - protein, 9 aa, Artificial Sequence
  Description of Artificial Sequence: Synthetic peptide
  Seed: QQLSLLMWI (CTG1B_HUMAN)
QLLSLLMWM

SEQ ID NO: 32036 - protein, 9 aa, Artificial Sequence
  Description of Artificial Sequence: Synthetic peptide
  Seed: AQDAPPLPV (CTG1B_HUMAN)
AQDAPPLPY

SEQ ID NO: 32037 - protein, 9 aa, Artificial Sequence
  Description of Artificial Sequence: Synthetic peptide
  Seed: TPMEAELAR (CTG1B_HUMAN)
TPMEAELAV

SEQ ID NO: 32038 - protein, 10 aa, Artificial Sequence
  Description of Artificial Sequence: Synthetic peptide
  Seed: QLQLSISSCL (CTG1B_HUMAN)
QMQLSISSCV

SEQ ID NO: 32039 - protein, 9 aa, Artificial Sequence
  Description of Artificial Sequence: Synthetic peptide
  Seed: TQCFLPVFL (CTG1B_HUMAN)
TLCFLPVFA

SEQ ID NO: 32040 - protein, 10 aa, Artificial Sequence
  Description of Artificial Sequence: Synthetic peptide
  Seed: SSCLQQLSLL (CTG1B_HUMAN)
STCLQQLSLY

SEQ ID NO: 32041 - protein, 10 aa, Artificial Sequence
  Description of Artificial Sequence: Synthetic peptide
  Seed: RASGPGGGAP (CTG1B_HUMAN)
RASGPGGGAY

SEQ ID NO: 32042 - protein, 10 aa, Artificial Sequence
  Description of Artificial Sequence: Synthetic peptide
  Seed: LEFYLAMPFA (CTG1B_HUMAN)
LAFYLAMPFF

SEQ ID NO: 32043 - protein, 9 aa, Artificial Sequence
  Description of Artificial Sequence: Synthetic peptide
  Seed: FTVSGNILT (CTG1B_HUMAN)
FAVSGNILI

SEQ ID NO: 32044 - protein, 9 aa, Artificial Sequence
  Description of Artificial Sequence: Synthetic peptide
  Seed: TAADHRQLQ (CTG1B_HUMAN)
TMADHRQLY

SEQ ID NO: 32045 - protein, 10 aa, Artificial Sequence
  Description of Artificial Sequence: Synthetic peptide
  Seed: MPFATPMEAE (CTG1B_HUMAN)
MIFATPMEAF

SEQ ID NO: 32046 - protein, 10 aa, Artificial Sequence
  Description of Artificial Sequence: Synthetic peptide
  Seed: QQLSLLMWIT (CTG1B_HUMAN)
QQLSLLMWII

SEQ ID NO: 32047 - protein, 10 aa, Artificial Sequence
  Description of Artificial Sequence: Synthetic peptide
  Seed: YLAMPFATPM (CTG1B_HUMAN)
YDAMPFATPM

SEQ ID NO: 32048 - protein, 11 aa, Artificial Sequence
  Description of Artificial Sequence: Synthetic peptide
  Seed: FYLAMPFATPM (CTG1B_HUMAN)
FRLAMPFATPV

SEQ ID NO: 32049 - protein, 10 aa, Artificial Sequence
  Description of Artificial Sequence: Synthetic peptide
  Seed: YLAMPFATPM (CTG1B_HUMAN)
YGAMPFATPF

SEQ ID NO: 32050 - protein, 10 aa, Artificial Sequence
  Description of Artificial Sequence: Synthetic peptide
  Seed: LEFYLAMPFA (CTG1B_HUMAN)
LMFYLAMPFY

SEQ ID NO: 32051 - protein, 10 aa, Artificial Sequence
  Description of Artificial Sequence: Synthetic peptide
  Seed: FLPVFLAQPP (CTG1B_HUMAN)
FQPVFLAQPA

SEQ ID NO: 32052 - protein, 11 aa, Artificial Sequence
  Description of Artificial Sequence: Synthetic peptide
  Seed: LTAADHRQLQL (CTG1B_HUMAN)
LTAADHRQLQF

SEQ ID NO: 32053 - protein, 9 aa, Artificial Sequence
  Description of Artificial Sequence: Synthetic peptide
  Seed: SGNILTIRL (CTG1B_HUMAN)
SSNILTIRL

SEQ ID NO: 32054 - protein, 10 aa, Artificial Sequence
  Description of Artificial Sequence: Synthetic peptide
  Seed: FYLAMPFATP (CTG1B_HUMAN)
FPLAMPFATM

SEQ ID NO: 32055 - protein, 11 aa, Artificial Sequence
  Description of Artificial Sequence: Synthetic peptide
  Seed: RLLEFYLAMPF (CTG1B_HUMAN)
RYLEFYLAMPV

SEQ ID NO: 32056 - protein, 9 aa, Artificial Sequence
  Description of Artificial Sequence: Synthetic peptide
  Seed: YLAMPFATP (CTG1B_HUMAN)
YAAMPFATL

SEQ ID NO: 32057 - protein, 9 aa, Artificial Sequence
  Description of Artificial Sequence: Synthetic peptide
  Seed: LAQPPSGQR (CTG1B_HUMAN)
LTQPPSGQY

SEQ ID NO: 32058 - protein, 9 aa, Artificial Sequence
  Description of Artificial Sequence: Synthetic peptide
  Seed: TPMEAELAR (CTG1B_HUMAN)
TAMEAELAA

SEQ ID NO: 32059 - protein, 10 aa, Artificial Sequence
  Description of Artificial Sequence: Synthetic peptide
  Seed: RGPHGGAASG (CTG1B_HUMAN)
RDPHGGAASF

SEQ ID NO: 32060 - protein, 9 aa, Artificial Sequence
  Description of Artificial Sequence: Synthetic peptide
  Seed: SISSCLQQL (CTG1B_HUMAN)
STSSCLQQI

SEQ ID NO: 32061 - protein, 11 aa, Artificial Sequence
  Description of Artificial Sequence: Synthetic peptide
  Seed: RLLEFYLAMPF (CTG1B_HUMAN)
RHLEFYLAMPY

SEQ ID NO: 32062 - protein, 11 aa, Artificial Sequence
  Description of Artificial Sequence: Synthetic peptide
  Seed: RLLEFYLAMPF (CTG1B_HUMAN)
RCLEFYLAMPM

SEQ ID NO: 32063 - protein, 9 aa, Artificial Sequence
  Description of Artificial Sequence: Synthetic peptide
  Seed: LLMWITQCF (CTG1B_HUMAN)
LMMWITQCT

SEQ ID NO: 32064 - protein, 9 aa, Artificial Sequence
  Description of Artificial Sequence: Synthetic peptide
  Seed: APPLPVPGV (CTG1B_HUMAN)
AVPLPVPGI

SEQ ID NO: 32065 - protein, 9 aa, Artificial Sequence
  Description of Artificial Sequence: Synthetic peptide
  Seed: ITQCFLPVF (CTG1B_HUMAN)
IFQCFLPVF

SEQ ID NO: 32066 - protein, 9 aa, Artificial Sequence
  Description of Artificial Sequence: Synthetic peptide
  Seed: FTVSGNILT (CTG1B_HUMAN)
FQVSGNILM

SEQ ID NO: 32067 - protein, 8 aa, Artificial Sequence
  Description of Artificial Sequence: Synthetic peptide
  Seed: GPRGAGAA (CTG1B_HUMAN)
GPRGAGAL

SEQ ID NO: 32068 - protein, 10 aa, Artificial Sequence
  Description of Artificial Sequence: Synthetic peptide
  Seed: GIPDGPGGNA (CTG1B_HUMAN)
GAPDGPGGNY

SEQ ID NO: 32069 - protein, 9 aa, Artificial Sequence
  Description of Artificial Sequence: Synthetic peptide
  Seed: LTAADHRQL (CTG1B_HUMAN)
LSAADHRQF

SEQ ID NO: 32070 - protein, 10 aa, Artificial Sequence
  Description of Artificial Sequence: Synthetic peptide
  Seed: LSISSCLQQL (CTG1B_HUMAN)
LTISSCLQQW

SEQ ID NO: 32071 - protein, 9 aa, Artificial Sequence
  Description of Artificial Sequence: Synthetic peptide
  Seed: LAMPFATPM (CTG1B_HUMAN)
LWMPFATPY

SEQ ID NO: 32072 - protein, 9 aa, Artificial Sequence
  Description of Artificial Sequence: Synthetic peptide
  Seed: TVSGNILTI (CTG1B_HUMAN)
TLSGNILTA

SEQ ID NO: 32073 - protein, 9 aa, Artificial Sequence
  Description of Artificial Sequence: Synthetic peptide
  Seed: ILTIRLTAA (CTG1B_HUMAN)
ILTIRLTAI

SEQ ID NO: 32074 - protein, 9 aa, Artificial Sequence
  Description of Artificial Sequence: Synthetic peptide
  Seed: LPVPGVLLK (CTG1B_HUMAN)
LSVPGVLLV

SEQ ID NO: 32075 - protein, 10 aa, Artificial Sequence
  Description of Artificial Sequence: Synthetic peptide
  Seed: FTVSGNILTI (CTG1B_HUMAN)
FLVSGNILTL

SEQ ID NO: 32076 - protein, 9 aa, Artificial Sequence
  Description of Artificial Sequence: Synthetic peptide
  Seed: LLMWITQCF (CTG1B_HUMAN)
LSMWITQCW

SEQ ID NO: 32077 - protein, 10 aa, Artificial Sequence
  Description of Artificial Sequence: Synthetic peptide
  Seed: FLPVFLAQPP (CTG1B_HUMAN)
FDPVFLAQPV

SEQ ID NO: 32078 - protein, 9 aa, Artificial Sequence
  Description of Artificial Sequence: Synthetic peptide
  Seed: YLAMPFATP (CTG1B_HUMAN)
YQAMPFATI

SEQ ID NO: 32079 - protein, 11 aa, Artificial Sequence
  Description of Artificial Sequence: Synthetic peptide
  Seed: RLLEFYLAMPF (CTG1B_HUMAN)
RCLEFYLAMPI

SEQ ID NO: 32080 - protein, 9 aa, Artificial Sequence
  Description of Artificial Sequence: Synthetic peptide
  Seed: SLAQDAPPL (CTG1B_HUMAN)
SKAQDAPPL

SEQ ID NO: 32081 - protein, 10 aa, Artificial Sequence
  Description of Artificial Sequence: Synthetic peptide
  Seed: LEFYLAMPFA (CTG1B_HUMAN)
LQFYLAMPFY

SEQ ID NO: 32082 - protein, 9 aa, Artificial Sequence
  Description of Artificial Sequence: Synthetic peptide
  Seed: IPDGPGGNA (CTG1B_HUMAN)
IIDGPGGNV

SEQ ID NO: 32083 - protein, 10 aa, Artificial Sequence
  Description of Artificial Sequence: Synthetic peptide
  Seed: ISSCLQQLSL (CTG1B_HUMAN)
ISSCLQQLSF

SEQ ID NO: 32084 - protein, 10 aa, Artificial Sequence
  Description of Artificial Sequence: Synthetic peptide
  Seed: YLAMPFATPM (CTG1B_HUMAN)
YNAMPFATPW

SEQ ID NO: 32085 - protein, 10 aa, Artificial Sequence
  Description of Artificial Sequence: Synthetic peptide
  Seed: ITQCFLPVFL (CTG1B_HUMAN)
ILQCFLPVFL

SEQ ID NO: 32086 - protein, 9 aa, Artificial Sequence
  Description of Artificial Sequence: Synthetic peptide
  Seed: AQDAPPLPV (CTG1B_HUMAN)
AMDAPPLPM

SEQ ID NO: 32087 - protein, 9 aa, Artificial Sequence
  Description of Artificial Sequence: Synthetic peptide
  Seed: LAMPFATPM (CTG1B_HUMAN)
LLMPFATPM

SEQ ID NO: 32088 - protein, 11 aa, Artificial Sequence
  Description of Artificial Sequence: Synthetic peptide
  Seed: FYLAMPFATPM (CTG1B_HUMAN)
FQLAMPFATPA

SEQ ID NO: 32089 - protein, 9 aa, Artificial Sequence
  Description of Artificial Sequence: Synthetic peptide
  Seed: AARASGPGG (CTG1B_HUMAN)
ASRASGPGS

SEQ ID NO: 32090 - protein, 9 aa, Artificial Sequence
  Description of Artificial Sequence: Synthetic peptide
  Seed: LQLSISSCL (CTG1B_HUMAN)
LTLSISSCF

SEQ ID NO: 32091 - protein, 9 aa, Artificial Sequence
  Description of Artificial Sequence: Synthetic peptide
  Seed: LTAADHRQL (CTG1B_HUMAN)
LAAADHRQV

SEQ ID NO: 32092 - protein, 10 aa, Artificial Sequence
  Description of Artificial Sequence: Synthetic peptide
  Seed: YLAMPFATPM (CTG1B_HUMAN)
YFAMPFATPL

SEQ ID NO: 32093 - protein, 9 aa, Artificial Sequence
  Description of Artificial Sequence: Synthetic peptide
  Seed: TPMEAELAR (CTG1B_HUMAN)
TAMEAELAF

SEQ ID NO: 32094 - protein, 11 aa, Artificial Sequence
  Description of Artificial Sequence: Synthetic peptide
  Seed: FYLAMPFATPM (CTG1B_HUMAN)
FNLAMPFATPM

SEQ ID NO: 32095 - protein, 9 aa, Artificial Sequence
  Description of Artificial Sequence: Synthetic peptide
  Seed: YLAMPFATP (CTG1B_HUMAN)
YIAMPFATA

SEQ ID NO: 32096 - protein, 10 aa, Artificial Sequence
  Description of Artificial Sequence: Synthetic peptide
  Seed: FYLAMPFATP (CTG1B_HUMAN)
FHLAMPFATA

SEQ ID NO: 32097 - protein, 10 aa, Artificial Sequence
  Description of Artificial Sequence: Synthetic peptide
  Seed: RLTAADHRQL (CTG1B_HUMAN)
RKTAADHRQF

SEQ ID NO: 32098 - protein, 10 aa, Artificial Sequence
  Description of Artificial Sequence: Synthetic peptide
  Seed: RSLAQDAPPL (CTG1B_HUMAN)
RSLAQDAPPY

SEQ ID NO: 32099 - protein, 11 aa, Artificial Sequence
  Description of Artificial Sequence: Synthetic peptide
  Seed: RASGPGGGAPR (CTG1B_HUMAN)
RVSGPGGGAPF

SEQ ID NO: 32100 - protein, 10 aa, Artificial Sequence
  Description of Artificial Sequence: Synthetic peptide
  Seed: GAPRGPHGGA (CTG1B_HUMAN)
GYPRGPHGGM

SEQ ID NO: 32101 - protein, 9 aa, Artificial Sequence
  Description of Artificial Sequence: Synthetic peptide
  Seed: LPVPGVLLK (CTG1B_HUMAN)
LTVPGVLLF

SEQ ID NO: 32102 - protein, 9 aa, Artificial Sequence
  Description of Artificial Sequence: Synthetic peptide
  Seed: RQLQLSISS (CTG1B_HUMAN)
RMLQLSISW

SEQ ID NO: 32103 - protein, 9 aa, Artificial Sequence
  Description of Artificial Sequence: Synthetic peptide
  Seed: AQDAPPLPV (CTG1B_HUMAN)
AADAPPLPI

SEQ ID NO: 32104 - protein, 9 aa, Artificial Sequence
  Description of Artificial Sequence: Synthetic peptide
  Seed: LPVFLAQPP (CTG1B_HUMAN)
LPVFLAQPL

SEQ ID NO: 32105 - protein, 9 aa, Artificial Sequence
  Description of Artificial Sequence: Synthetic peptide
  Seed: TVSGNILTI (CTG1B_HUMAN)
TQSGNILTL

SEQ ID NO: 32106 - protein, 9 aa, Artificial Sequence
  Description of Artificial Sequence: Synthetic peptide
  Seed: RQLQLSISS (CTG1B_HUMAN)
RLLQLSISV

SEQ ID NO: 32107 - protein, 10 aa, Artificial Sequence
  Description of Artificial Sequence: Synthetic peptide
  Seed: AMPFATPMEA (CTG1B_HUMAN)
ASPFATPMEY

SEQ ID NO: 32108 - protein, 9 aa, Artificial Sequence
  Description of Artificial Sequence: Synthetic peptide
  Seed: AQDAPPLPV (CTG1B_HUMAN)
AQDAPPLPF

SEQ ID NO: 32109 - protein, 11 aa, Artificial Sequence
  Description of Artificial Sequence: Synthetic peptide
  Seed: RASGPGGGAPR (CTG1B_HUMAN)
RPSGPGGGAPI

SEQ ID NO: 32110 - protein, 10 aa, Artificial Sequence
  Description of Artificial Sequence: Synthetic peptide
  Seed: FLAQPPSGQR (CTG1B_HUMAN)
FTAQPPSGQM

SEQ ID NO: 32111 - protein, 10 aa, Artificial Sequence
  Description of Artificial Sequence: Synthetic peptide
  Seed: LQQLSLLMWI (CTG1B_HUMAN)
LGQLSLLMWV

SEQ ID NO: 32112 - protein, 11 aa, Artificial Sequence
  Description of Artificial Sequence: Synthetic peptide
  Seed: RLLEFYLAMPF (CTG1B_HUMAN)
RNLEFYLAMPV

SEQ ID NO: 32113 - protein, 10 aa, Artificial Sequence
  Description of Artificial Sequence: Synthetic peptide
  Seed: LMWITQCFLP (CTG1B_HUMAN)
LMWITQCFLL

SEQ ID NO: 32114 - protein, 11 aa, Artificial Sequence
  Description of Artificial Sequence: Synthetic peptide
  Seed: RASGPGGGAPR (CTG1B_HUMAN)
RASGPGGGAPM

SEQ ID NO: 32115 - protein, 10 aa, Artificial Sequence
  Description of Artificial Sequence: Synthetic peptide
  Seed: LQQLSLLMWI (CTG1B_HUMAN)
LRQLSLLMWV

SEQ ID NO: 32116 - protein, 10 aa, Artificial Sequence
  Description of Artificial Sequence: Synthetic peptide
  Seed: KEFTVSGNIL (CTG1B_HUMAN)
KVFTVSGNIF

SEQ ID NO: 32117 - protein, 11 aa, Artificial Sequence
  Description of Artificial Sequence: Synthetic peptide
  Seed: FYLAMPFATPM (CTG1B_HUMAN)
FILAMPFATPF

SEQ ID NO: 32118 - protein, 9 aa, Artificial Sequence
  Description of Artificial Sequence: Synthetic peptide
  Seed: LMWITQCFL (CTG1B_HUMAN)
LQWITQCFV

SEQ ID NO: 32119 - protein, 10 aa, Artificial Sequence
  Description of Artificial Sequence: Synthetic peptide
  Seed: RGPESRLLEF (CTG1B_HUMAN)
RLPESRLLEY

SEQ ID NO: 32120 - protein, 9 aa, Artificial Sequence
  Description of Artificial Sequence: Synthetic peptide
  Seed: MPFATPMEA (CTG1B_HUMAN)
MSFATPMEL

SEQ ID NO: 32121 - protein, 9 aa, Artificial Sequence
  Description of Artificial Sequence: Synthetic peptide
  Seed: CLQQLSLLM (CTG1B_HUMAN)
CQQQLSLLY

SEQ ID NO: 32122 - protein, 10 aa, Artificial Sequence
  Description of Artificial Sequence: Synthetic peptide
  Seed: LLMWITQCFL (CTG1B_HUMAN)
LIMWITQCFR

SEQ ID NO: 32123 - protein, 9 aa, Artificial Sequence
  Description of Artificial Sequence: Synthetic peptide
  Seed: FATPMEAEL (CTG1B_HUMAN)
FGTPMEAEY

SEQ ID NO: 32124 - protein, 9 aa, Artificial Sequence
  Description of Artificial Sequence: Synthetic peptide
  Seed: AQDAPPLPV (CTG1B_HUMAN)
AGDAPPLPI

SEQ ID NO: 32125 - protein, 10 aa, Artificial Sequence
  Description of Artificial Sequence: Synthetic peptide
  Seed: RSLAQDAPPL (CTG1B_HUMAN)
RTLAQDAPPW

SEQ ID NO: 32126 - protein, 9 aa, Artificial Sequence
  Description of Artificial Sequence: Synthetic peptide
  Seed: AARASGPGG (CTG1B_HUMAN)
ATRASGPGY

SEQ ID NO: 32127 - protein, 9 aa, Artificial Sequence
  Description of Artificial Sequence: Synthetic peptide
  Seed: LAMPFATPM (CTG1B_HUMAN)
LFMPFATPF

SEQ ID NO: 32128 - protein, 9 aa, Artificial Sequence
  Description of Artificial Sequence: Synthetic peptide
  Seed: RLLEFYLAM (CTG1B_HUMAN)
RMLEFYLAS

SEQ ID NO: 32129 - protein, 9 aa, Artificial Sequence
  Description of Artificial Sequence: Synthetic peptide
  Seed: SLAQDAPPL (CTG1B_HUMAN)
SSAQDAPPL

SEQ ID NO: 32130 - protein, 9 aa, Artificial Sequence
  Description of Artificial Sequence: Synthetic peptide
  Seed: TVSGNILTI (CTG1B_HUMAN)
TVSGNILTF

SEQ ID NO: 32131 - protein, 10 aa, Artificial Sequence
  Description of Artificial Sequence: Synthetic peptide
  Seed: YLAMPFATPM (CTG1B_HUMAN)
YAAMPFATPM

SEQ ID NO: 32132 - protein, 11 aa, Artificial Sequence
  Description of Artificial Sequence: Synthetic peptide
  Seed: RASGPGGGAPR (CTG1B_HUMAN)
RSSGPGGGAPR

SEQ ID NO: 32133 - protein, 11 aa, Artificial Sequence
  Description of Artificial Sequence: Synthetic peptide
  Seed: KEFTVSGNILT (CTG1B_HUMAN)
KEFTVSGNILL

SEQ ID NO: 32134 - protein, 9 aa, Artificial Sequence
  Description of Artificial Sequence: Synthetic peptide
  Seed: SGPGGGAPR (CTG1B_HUMAN)
SGPGGGAPL

SEQ ID NO: 32135 - protein, 9 aa, Artificial Sequence
  Description of Artificial Sequence: Synthetic peptide
  Seed: LEFYLAMPF (CTG1B_HUMAN)
LQFYLAMPM

SEQ ID NO: 32136 - protein, 9 aa, Artificial Sequence
  Description of Artificial Sequence: Synthetic peptide
  Seed: SCLQQLSLL (CTG1B_HUMAN)
STLQQLSLL

SEQ ID NO: 32137 - protein, 10 aa, Artificial Sequence
  Description of Artificial Sequence: Synthetic peptide
  Seed: FLPVFLAQPP (CTG1B_HUMAN)
FGPVFLAQPT

SEQ ID NO: 32138 - protein, 11 aa, Artificial Sequence
  Description of Artificial Sequence: Synthetic peptide
  Seed: FYLAMPFATPM (CTG1B_HUMAN)
FILAMPFATPL

SEQ ID NO: 32139 - protein, 9 aa, Artificial Sequence
  Description of Artificial Sequence: Synthetic peptide
  Seed: ITQCFLPVF (CTG1B_HUMAN)
IYQCFLPVI

SEQ ID NO: 32140 - protein, 9 aa, Artificial Sequence
  Description of Artificial Sequence: Synthetic peptide
  Seed: LQQLSLLMW (CTG1B_HUMAN)
LQQLSLLMM

SEQ ID NO: 32141 - protein, 9 aa, Artificial Sequence
  Description of Artificial Sequence: Synthetic peptide
  Seed: APPLPVPGV (CTG1B_HUMAN)
ATPLPVPGV

SEQ ID NO: 32142 - protein, 10 aa, Artificial Sequence
  Description of Artificial Sequence: Synthetic peptide
  Seed: RSLAQDAPPL (CTG1B_HUMAN)
RRLAQDAPPV

SEQ ID NO: 32143 - protein, 10 aa, Artificial Sequence
  Description of Artificial Sequence: Synthetic peptide
  Seed: YLAMPFATPM (CTG1B_HUMAN)
YVAMPFATPM

SEQ ID NO: 32144 - protein, 9 aa, Artificial Sequence
  Description of Artificial Sequence: Synthetic peptide
  Seed: AQDAPPLPV (CTG1B_HUMAN)
ACDAPPLPV

SEQ ID NO: 32145 - protein, 9 aa, Artificial Sequence
  Description of Artificial Sequence: Synthetic peptide
  Seed: FLPVFLAQP (CTG1B_HUMAN)
FAPVFLAQI

SEQ ID NO: 32146 - protein, 8 aa, Artificial Sequence
  Description of Artificial Sequence: Synthetic peptide
  Seed: LMWITQCF (CTG1B_HUMAN)
LQWITQCF

SEQ ID NO: 32147 - protein, 9 aa, Artificial Sequence
  Description of Artificial Sequence: Synthetic peptide
  Seed: IPDGPGGNA (CTG1B_HUMAN)
IQDGPGGNL

SEQ ID NO: 32148 - protein, 9 aa, Artificial Sequence
  Description of Artificial Sequence: Synthetic peptide
  Seed: LLMWITQCF (CTG1B_HUMAN)
LIMWITQCV

SEQ ID NO: 32149 - protein, 9 aa, Artificial Sequence
  Description of Artificial Sequence: Synthetic peptide
  Seed: RLLEFYLAM (CTG1B_HUMAN)
RTLEFYLAI

SEQ ID NO: 32150 - protein, 9 aa, Artificial Sequence
  Description of Artificial Sequence: Synthetic peptide
  Seed: AADHRQLQL (CTG1B_HUMAN)
AADHRQLQF

SEQ ID NO: 32151 - protein, 9 aa, Artificial Sequence
  Description of Artificial Sequence: Synthetic peptide
  Seed: AADHRQLQL (CTG1B_HUMAN)
AMDHRQLQY

SEQ ID NO: 32152 - protein, 10 aa, Artificial Sequence
  Description of Artificial Sequence: Synthetic peptide
  Seed: MPFATPMEAE (CTG1B_HUMAN)
MLFATPMEAY

SEQ ID NO: 32153 - protein, 10 aa, Artificial Sequence
  Description of Artificial Sequence: Synthetic peptide
  Seed: YLAMPFATPM (CTG1B_HUMAN)
YRAMPFATPY

SEQ ID NO: 32154 - protein, 9 aa, Artificial Sequence
  Description of Artificial Sequence: Synthetic peptide
  Seed: APPLPVPGV (CTG1B_HUMAN)
AAPLPVPGY

SEQ ID NO: 32155 - protein, 9 aa, Artificial Sequence
  Description of Artificial Sequence: Synthetic peptide
  Seed: SGPGGGAPR (CTG1B_HUMAN)
SLPGGGAPL

SEQ ID NO: 32156 - protein, 9 aa, Artificial Sequence
  Description of Artificial Sequence: Synthetic peptide
  Seed: ADGPGGPGI (CTG1B_HUMAN)
AEGPGGPGA

SEQ ID NO: 32157 - protein, 9 aa, Artificial Sequence
  Description of Artificial Sequence: Synthetic peptide
  Seed: LEFYLAMPF (CTG1B_HUMAN)
LMFYLAMPV

SEQ ID NO: 32158 - protein, 9 aa, Artificial Sequence
  Description of Artificial Sequence: Synthetic peptide
  Seed: LQQLSLLMW (CTG1B_HUMAN)
LSQLSLLMF

SEQ ID NO: 32159 - protein, 8 aa, Artificial Sequence
  Description of Artificial Sequence: Synthetic peptide
  Seed: QDAPPLPV (CTG1B_HUMAN)
QEAPPLPL

SEQ ID NO: 32160 - protein, 9 aa, Artificial Sequence
  Description of Artificial Sequence: Synthetic peptide
  Seed: RLLEFYLAM (CTG1B_HUMAN)
RNLEFYLAF

SEQ ID NO: 32161 - protein, 9 aa, Artificial Sequence
  Description of Artificial Sequence: Synthetic peptide
  Seed: AADHRQLQL (CTG1B_HUMAN)
AIDHRQLQV

SEQ ID NO: 32162 - protein, 9 aa, Artificial Sequence
  Description of Artificial Sequence: Synthetic peptide
  Seed: DAPPLPVPG (CTG1B_HUMAN)
DSPPLPVPI

SEQ ID NO: 32163 - protein, 11 aa, Artificial Sequence
  Description of Artificial Sequence: Synthetic peptide
  Seed: FYLAMPFATPM (CTG1B_HUMAN)
FALAMPFATPY

SEQ ID NO: 32164 - protein, 11 aa, Artificial Sequence
  Description of Artificial Sequence: Synthetic peptide
  Seed: GAPRGPHGGAA (CTG1B_HUMAN)
GFPRGPHGGAL

SEQ ID NO: 32165 - protein, 11 aa, Artificial Sequence
  Description of Artificial Sequence: Synthetic peptide
  Seed: YLAMPFATPME (CTG1B_HUMAN)
YFAMPFATPMV

SEQ ID NO: 32166 - protein, 11 aa, Artificial Sequence
  Description of Artificial Sequence: Synthetic peptide
  Seed: RLLEFYLAMPF (CTG1B_HUMAN)
RYLEFYLAMPI

SEQ ID NO: 32167 - protein, 10 aa, Artificial Sequence
  Description of Artificial Sequence: Synthetic peptide
  Seed: GIPDGPGGNA (CTG1B_HUMAN)
GLPDGPGGNI

SEQ ID NO: 32168 - protein, 9 aa, Artificial Sequence
  Description of Artificial Sequence: Synthetic peptide
  Seed: RLLEFYLAM (CTG1B_HUMAN)
RVLEFYLAT

SEQ ID NO: 32169 - protein, 9 aa, Artificial Sequence
  Description of Artificial Sequence: Synthetic peptide
  Seed: TVSGNILTI (CTG1B_HUMAN)
TGSGNILTV

SEQ ID NO: 32170 - protein, 9 aa, Artificial Sequence
  Description of Artificial Sequence: Synthetic peptide
  Seed: TPMEAELAR (CTG1B_HUMAN)
TTMEAELAR

SEQ ID NO: 32171 - protein, 9 aa, Artificial Sequence
  Description of Artificial Sequence: Synthetic peptide
  Seed: MPFATPMEA (CTG1B_HUMAN)
MLFATPMEW

SEQ ID NO: 32172 - protein, 9 aa, Artificial Sequence
  Description of Artificial Sequence: Synthetic peptide
  Seed: SGNILTIRL (CTG1B_HUMAN)
SANILTIRF

SEQ ID NO: 32173 - protein, 11 aa, Artificial Sequence
  Description of Artificial Sequence: Synthetic peptide
  Seed: RASGPGGGAPR (CTG1B_HUMAN)
RISGPGGGAPF

SEQ ID NO: 32174 - protein, 9 aa, Artificial Sequence
  Description of Artificial Sequence: Synthetic peptide
  Seed: LLMWITQCF (CTG1B_HUMAN)
LPMWITQCA

SEQ ID NO: 32175 - protein, 10 aa, Artificial Sequence
  Description of Artificial Sequence: Synthetic peptide
  Seed: MPFATPMEAE (CTG1B_HUMAN)
MIFATPMEAY

SEQ ID NO: 32176 - protein, 9 aa, Artificial Sequence
  Description of Artificial Sequence: Synthetic peptide
  Seed: LEFYLAMPF (CTG1B_HUMAN)
LNFYLAMPM

SEQ ID NO: 32177 - protein, 10 aa, Artificial Sequence
  Description of Artificial Sequence: Synthetic peptide
  Seed: RGPESRLLEF (CTG1B_HUMAN)
RNPESRLLEL

SEQ ID NO: 32178 - protein, 9 aa, Artificial Sequence
  Description of Artificial Sequence: Synthetic peptide
  Seed: YLAMPFATP (CTG1B_HUMAN)
YVAMPFATL

SEQ ID NO: 32179 - protein, 10 aa, Artificial Sequence
  Description of Artificial Sequence: Synthetic peptide
  Seed: KEFTVSGNIL (CTG1B_HUMAN)
KQFTVSGNII

SEQ ID NO: 32180 - protein, 11 aa, Artificial Sequence
  Description of Artificial Sequence: Synthetic peptide
  Seed: YLAMPFATPME (CTG1B_HUMAN)
YNAMPFATPMV

SEQ ID NO: 32181 - protein, 10 aa, Artificial Sequence
  Description of Artificial Sequence: Synthetic peptide
  Seed: FTVSGNILTI (CTG1B_HUMAN)
FSVSGNILTL

SEQ ID NO: 32182 - protein, 9 aa, Artificial Sequence
  Description of Artificial Sequence: Synthetic peptide
  Seed: LPVPGVLLK (CTG1B_HUMAN)
LVVPGVLLK

SEQ ID NO: 32183 - protein, 9 aa, Artificial Sequence
  Description of Artificial Sequence: Synthetic peptide
  Seed: IPDGPGGNA (CTG1B_HUMAN)
ILDGPGGNF

SEQ ID NO: 32184 - protein, 10 aa, Artificial Sequence
  Description of Artificial Sequence: Synthetic peptide
  Seed: SRLLEFYLAM (CTG1B_HUMAN)
SNLLEFYLAL

SEQ ID NO: 32185 - protein, 9 aa, Artificial Sequence
  Description of Artificial Sequence: Synthetic peptide
  Seed: LEFYLAMPF (CTG1B_HUMAN)
LTFYLAMPF

SEQ ID NO: 32186 - protein, 9 aa, Artificial Sequence
  Description of Artificial Sequence: Synthetic peptide
  Seed: LQQLSLLMW (CTG1B_HUMAN)
LSQLSLLMW

SEQ ID NO: 32187 - protein, 9 aa, Artificial Sequence
  Description of Artificial Sequence: Synthetic peptide
  Seed: RLLEFYLAM (CTG1B_HUMAN)
RILEFYLAM

SEQ ID NO: 32188 - protein, 9 aa, Artificial Sequence
  Description of Artificial Sequence: Synthetic peptide
  Seed: SLLMWITQC (CTG1B_HUMAN)
SLLMWITQS

SEQ ID NO: 32189 - protein, 9 aa, Artificial Sequence
  Description of Artificial Sequence: Synthetic peptide
  Seed: LQLSISSCL (CTG1B_HUMAN)
LSLSISSCY

SEQ ID NO: 32190 - protein, 9 aa, Artificial Sequence
  Description of Artificial Sequence: Synthetic peptide
  Seed: MQAEGRGTG (CTG1B_HUMAN)
MTAEGRGTY

SEQ ID NO: 32191 - protein, 11 aa, Artificial Sequence
  Description of Artificial Sequence: Synthetic peptide
  Seed: RLLEFYLAMPF (CTG1B_HUMAN)
RLLEFYLAMPT

SEQ ID NO: 32192 - protein, 9 aa, Artificial Sequence
  Description of Artificial Sequence: Synthetic peptide
  Seed: TQCFLPVFL (CTG1B_HUMAN)
TICFLPVFI

SEQ ID NO: 32193 - protein, 9 aa, Artificial Sequence
  Description of Artificial Sequence: Synthetic peptide
  Seed: MPFATPMEA (CTG1B_HUMAN)
MCFATPMEY

SEQ ID NO: 32194 - protein, 9 aa, Artificial Sequence
  Description of Artificial Sequence: Synthetic peptide
  Seed: AQDAPPLPV (CTG1B_HUMAN)
ALDAPPLPY

SEQ ID NO: 32195 - protein, 10 aa, Artificial Sequence
  Description of Artificial Sequence: Synthetic peptide
  Seed: RGPESRLLEF (CTG1B_HUMAN)
RKPESRLLEL

SEQ ID NO: 32196 - protein, 11 aa, Artificial Sequence
  Description of Artificial Sequence: Synthetic peptide
  Seed: GAPRGPHGGAA (CTG1B_HUMAN)
GAPRGPHGGAL

SEQ ID NO: 32197 - protein, 10 aa, Artificial Sequence
  Description of Artificial Sequence: Synthetic peptide
  Seed: FLPVFLAQPP (CTG1B_HUMAN)
FQPVFLAQPV

SEQ ID NO: 32198 - protein, 9 aa, Artificial Sequence
  Description of Artificial Sequence: Synthetic peptide
  Seed: FATPMEAEL (CTG1B_HUMAN)
FYTPMEAEY

SEQ ID NO: 32199 - protein, 9 aa, Artificial Sequence
  Description of Artificial Sequence: Synthetic peptide
  Seed: LMWITQCFL (CTG1B_HUMAN)
LAWITQCFY

SEQ ID NO: 32200 - protein, 9 aa, Artificial Sequence
  Description of Artificial Sequence: Synthetic peptide
  Seed: RQLQLSISS (CTG1B_HUMAN)
RMLQLSISM

SEQ ID NO: 32201 - protein, 9 aa, Artificial Sequence
  Description of Artificial Sequence: Synthetic peptide
  Seed: LEFYLAMPF (CTG1B_HUMAN)
LKFYLAMPY

SEQ ID NO: 32202 - protein, 10 aa, Artificial Sequence
  Description of Artificial Sequence: Synthetic peptide
  Seed: RGPHGGAASG (CTG1B_HUMAN)
RSPHGGAASM

SEQ ID NO: 32203 - protein, 11 aa, Artificial Sequence
  Description of Artificial Sequence: Synthetic peptide
  Seed: FYLAMPFATPM (CTG1B_HUMAN)
FSLAMPFATPF

SEQ ID NO: 32204 - protein, 10 aa, Artificial Sequence
  Description of Artificial Sequence: Synthetic peptide
  Seed: SRLLEFYLAM (CTG1B_HUMAN)
SALLEFYLAL

SEQ ID NO: 32205 - protein, 9 aa, Artificial Sequence
  Description of Artificial Sequence: Synthetic peptide
  Seed: GPRGAGAAR (CTG1B_HUMAN)
GPRGAGAAV

SEQ ID NO: 32206 - protein, 9 aa, Artificial Sequence
  Description of Artificial Sequence: Synthetic peptide
  Seed: LAMPFATPM (CTG1B_HUMAN)
LTMPFATPT

SEQ ID NO: 32207 - protein, 9 aa, Artificial Sequence
  Description of Artificial Sequence: Synthetic peptide
  Seed: SCLQQLSLL (CTG1B_HUMAN)
SALQQLSLV

SEQ ID NO: 32208 - protein, 9 aa, Artificial Sequence
  Description of Artificial Sequence: Synthetic peptide
  Seed: GPHGGAASG (CTG1B_HUMAN)
GPHGGAASM

SEQ ID NO: 32209 - protein, 10 aa, Artificial Sequence
  Description of Artificial Sequence: Synthetic peptide
  Seed: FTVSGNILTI (CTG1B_HUMAN)
FGVSGNILTF

SEQ ID NO: 32210 - protein, 11 aa, Artificial Sequence
  Description of Artificial Sequence: Synthetic peptide
  Seed: FYLAMPFATPM (CTG1B_HUMAN)
FFLAMPFATPL

SEQ ID NO: 32211 - protein, 10 aa, Artificial Sequence
  Description of Artificial Sequence: Synthetic peptide
  Seed: EFTVSGNILT (CTG1B_HUMAN)
ECTVSGNILI

SEQ ID NO: 32212 - protein, 8 aa, Artificial Sequence
  Description of Artificial Sequence: Synthetic peptide
  Seed: LQQLSLLM (CTG1B_HUMAN)
LQQLSLLF

SEQ ID NO: 32213 - protein, 9 aa, Artificial Sequence
  Description of Artificial Sequence: Synthetic peptide
  Seed: RLLEFYLAM (CTG1B_HUMAN)
RSLEFYLAI

SEQ ID NO: 32214 - protein, 9 aa, Artificial Sequence
  Description of Artificial Sequence: Synthetic peptide
  Seed: LAQPPSGQR (CTG1B_HUMAN)
LVQPPSGQF

SEQ ID NO: 32215 - protein, 10 aa, Artificial Sequence
  Description of Artificial Sequence: Synthetic peptide
  Seed: RASGPGGGAP (CTG1B_HUMAN)
RPSGPGGGAA

SEQ ID NO: 32216 - protein, 10 aa, Artificial Sequence
  Description of Artificial Sequence: Synthetic peptide
  Seed: YLAMPFATPM (CTG1B_HUMAN)
YHAMPFATPA

SEQ ID NO: 32217 - protein, 11 aa, Artificial Sequence
  Description of Artificial Sequence: Synthetic peptide
  Seed: AARASGPGGGA (CTG1B_HUMAN)
APRASGPGGGC

SEQ ID NO: 32218 - protein, 10 aa, Artificial Sequence
  Description of Artificial Sequence: Synthetic peptide
  Seed: RLLEFYLAMP (CTG1B_HUMAN)
RKLEFYLAMV

SEQ ID NO: 32219 - protein, 10 aa, Artificial Sequence
  Description of Artificial Sequence: Synthetic peptide
  Seed: SRLLEFYLAM (CTG1B_HUMAN)
SALLEFYLAF

SEQ ID NO: 32220 - protein, 9 aa, Artificial Sequence
  Description of Artificial Sequence: Synthetic peptide
  Seed: SLLMWITQC (CTG1B_HUMAN)
SQLMWITQA

SEQ ID NO: 32221 - protein, 11 aa, Artificial Sequence
  Description of Artificial Sequence: Synthetic peptide
  Seed: RASGPGGGAPR (CTG1B_HUMAN)
RASGPGGGAPV

SEQ ID NO: 32222 - protein, 9 aa, Artificial Sequence
  Description of Artificial Sequence: Synthetic peptide
  Seed: CLQQLSLLM (CTG1B_HUMAN)
CKQQLSLLM

SEQ ID NO: 32223 - protein, 10 aa, Artificial Sequence
  Description of Artificial Sequence: Synthetic peptide
  Seed: GIPDGPGGNA (CTG1B_HUMAN)
GLPDGPGGNV

SEQ ID NO: 32224 - protein, 11 aa, Artificial Sequence
  Description of Artificial Sequence: Synthetic peptide
  Seed: GPRGAGAARAS (CTG1B_HUMAN)
GPRGAGAARAI

SEQ ID NO: 32225 - protein, 11 aa, Artificial Sequence
  Description of Artificial Sequence: Synthetic peptide
  Seed: RQLQLSISSCL (CTG1B_HUMAN)
RFLQLSISSCF

SEQ ID NO: 32226 - protein, 9 aa, Artificial Sequence
  Description of Artificial Sequence: Synthetic peptide
  Seed: MQAEGRGTG (CTG1B_HUMAN)
MQAEGRGTW

SEQ ID NO: 32227 - protein, 9 aa, Artificial Sequence
  Description of Artificial Sequence: Synthetic peptide
  Seed: YLAMPFATP (CTG1B_HUMAN)
YVAMPFATV

SEQ ID NO: 32228 - protein, 11 aa, Artificial Sequence
  Description of Artificial Sequence: Synthetic peptide
  Seed: GPGEAGATGGR (CTG1B_HUMAN)
GTGEAGATGGR

SEQ ID NO: 32229 - protein, 11 aa, Artificial Sequence
  Description of Artificial Sequence: Synthetic peptide
  Seed: RASGPGGGAPR (CTG1B_HUMAN)
RSSGPGGGAPL

SEQ ID NO: 32230 - protein, 9 aa, Artificial Sequence
  Description of Artificial Sequence: Synthetic peptide
  Seed: TPMEAELAR (CTG1B_HUMAN)
TPMEAELAS

SEQ ID NO: 32231 - protein, 11 aa, Artificial Sequence
  Description of Artificial Sequence: Synthetic peptide
  Seed: RQLQLSISSCL (CTG1B_HUMAN)
RSLQLSISSCY

SEQ ID NO: 32232 - protein, 9 aa, Artificial Sequence
  Description of Artificial Sequence: Synthetic peptide
  Seed: SSCLQQLSL (CTG1B_HUMAN)
SQCLQQLSW

SEQ ID NO: 32233 - protein, 10 aa, Artificial Sequence
  Description of Artificial Sequence: Synthetic peptide
  Seed: IPDGPGGNAG (CTG1B_HUMAN)
IPDGPGGNAA

SEQ ID NO: 32234 - protein, 10 aa, Artificial Sequence
  Description of Artificial Sequence: Synthetic peptide
  Seed: YLAMPFATPM (CTG1B_HUMAN)
YMAMPFATPL

SEQ ID NO: 32235 - protein, 9 aa, Artificial Sequence
  Description of Artificial Sequence: Synthetic peptide
  Seed: RQLQLSISS (CTG1B_HUMAN)
RSLQLSISY

SEQ ID NO: 32236 - protein, 10 aa, Artificial Sequence
  Description of Artificial Sequence: Synthetic peptide
  Seed: YLAMPFATPM (CTG1B_HUMAN)
YCAMPFATPF

SEQ ID NO: 32237 - protein, 9 aa, Artificial Sequence
  Description of Artificial Sequence: Synthetic peptide
  Seed: LEFYLAMPF (CTG1B_HUMAN)
LSFYLAMPM

SEQ ID NO: 32238 - protein, 11 aa, Artificial Sequence
  Description of Artificial Sequence: Synthetic peptide
  Seed: FYLAMPFATPM (CTG1B_HUMAN)
FHLAMPFATPL

SEQ ID NO: 32239 - protein, 11 aa, Artificial Sequence
  Description of Artificial Sequence: Synthetic peptide
  Seed: RLLEFYLAMPF (CTG1B_HUMAN)
RTLEFYLAMPF

SEQ ID NO: 32240 - protein, 10 aa, Artificial Sequence
  Description of Artificial Sequence: Synthetic peptide
  Seed: SRLLEFYLAM (CTG1B_HUMAN)
SHLLEFYLAM

SEQ ID NO: 32241 - protein, 9 aa, Artificial Sequence
  Description of Artificial Sequence: Synthetic peptide
  Seed: LEFYLAMPF (CTG1B_HUMAN)
LPFYLAMPQ

SEQ ID NO: 32242 - protein, 9 aa, Artificial Sequence
  Description of Artificial Sequence: Synthetic peptide
  Seed: AARASGPGG (CTG1B_HUMAN)
AQRASGPGK

SEQ ID NO: 32243 - protein, 9 aa, Artificial Sequence
  Description of Artificial Sequence: Synthetic peptide
  Seed: SCLQQLSLL (CTG1B_HUMAN)
STLQQLSLV

SEQ ID NO: 32244 - protein, 11 aa, Artificial Sequence
  Description of Artificial Sequence: Synthetic peptide
  Seed: ARASGPGGGAP (CTG1B_HUMAN)
ARASGPGGGAL

SEQ ID NO: 32245 - protein, 9 aa, Artificial Sequence
  Description of Artificial Sequence: Synthetic peptide
  Seed: ITQCFLPVF (CTG1B_HUMAN)
IMQCFLPVF

SEQ ID NO: 32246 - protein, 9 aa, Artificial Sequence
  Description of Artificial Sequence: Synthetic peptide
  Seed: SLAQDAPPL (CTG1B_HUMAN)
SKAQDAPPM

SEQ ID NO: 32247 - protein, 10 aa, Artificial Sequence
  Description of Artificial Sequence: Synthetic peptide
  Seed: YLAMPFATPM (CTG1B_HUMAN)
YVAMPFATPA

SEQ ID NO: 32248 - protein, 9 aa, Artificial Sequence
  Description of Artificial Sequence: Synthetic peptide
  Seed: LAQPPSGQR (CTG1B_HUMAN)
LTQPPSGQM

SEQ ID NO: 32249 - protein, 10 aa, Artificial Sequence
  Description of Artificial Sequence: Synthetic peptide
  Seed: YLAMPFATPM (CTG1B_HUMAN)
YKAMPFATPI

SEQ ID NO: 32250 - protein, 10 aa, Artificial Sequence
  Description of Artificial Sequence: Synthetic peptide
  Seed: MEAELARRSL (CTG1B_HUMAN)
MAAELARRSY

SEQ ID NO: 32251 - protein, 11 aa, Artificial Sequence
  Description of Artificial Sequence: Synthetic peptide
  Seed: KEFTVSGNILT (CTG1B_HUMAN)
KEFTVSGNILA

SEQ ID NO: 32252 - protein, 10 aa, Artificial Sequence
  Description of Artificial Sequence: Synthetic peptide
  Seed: APRGPHGGAA (CTG1B_HUMAN)
APRGPHGGAT

SEQ ID NO: 32253 - protein, 11 aa, Artificial Sequence
  Description of Artificial Sequence: Synthetic peptide
  Seed: RASGPGGGAPR (CTG1B_HUMAN)
RTSGPGGGAPR

SEQ ID NO: 32254 - protein, 9 aa, Artificial Sequence
  Description of Artificial Sequence: Synthetic peptide
  Seed: ILTIRLTAA (CTG1B_HUMAN)
ILTIRLTAV

SEQ ID NO: 32255 - protein, 9 aa, Artificial Sequence
  Description of Artificial Sequence: Synthetic peptide
  Seed: LLMWITQCF (CTG1B_HUMAN)
LIMWITQCI

SEQ ID NO: 32256 - protein, 11 aa, Artificial Sequence
  Description of Artificial Sequence: Synthetic peptide
  Seed: LAMPFATPMEA (CTG1B_HUMAN)
LWMPFATPMEA

SEQ ID NO: 32257 - protein, 10 aa, Artificial Sequence
  Description of Artificial Sequence: Synthetic peptide
  Seed: RGPHGGAASG (CTG1B_HUMAN)
RDPHGGAASI

SEQ ID NO: 32258 - protein, 10 aa, Artificial Sequence
  Description of Artificial Sequence: Synthetic peptide
  Seed: FYLAMPFATP (CTG1B_HUMAN)
FNLAMPFATV

SEQ ID NO: 32259 - protein, 10 aa, Artificial Sequence
  Description of Artificial Sequence: Synthetic peptide
  Seed: RSLAQDAPPL (CTG1B_HUMAN)
RMLAQDAPPI

SEQ ID NO: 32260 - protein, 9 aa, Artificial Sequence
  Description of Artificial Sequence: Synthetic peptide
  Seed: SLLMWITQC (CTG1B_HUMAN)
SLLMWITQM

SEQ ID NO: 32261 - protein, 9 aa, Artificial Sequence
  Description of Artificial Sequence: Synthetic peptide
  Seed: SSCLQQLSL (CTG1B_HUMAN)
SLCLQQLSY

SEQ ID NO: 32262 - protein, 10 aa, Artificial Sequence
  Description of Artificial Sequence: Synthetic peptide
  Seed: FLPVFLAQPP (CTG1B_HUMAN)
FVPVFLAQPA

SEQ ID NO: 32263 - protein, 10 aa, Artificial Sequence
  Description of Artificial Sequence: Synthetic peptide
  Seed: LAQDAPPLPV (CTG1B_HUMAN)
LLQDAPPLPL

SEQ ID NO: 32264 - protein, 10 aa, Artificial Sequence
  Description of Artificial Sequence: Synthetic peptide
  Seed: RGPHGGAASG (CTG1B_HUMAN)
RVPHGGAASA

SEQ ID NO: 32265 - protein, 10 aa, Artificial Sequence
  Description of Artificial Sequence: Synthetic peptide
  Seed: SRLLEFYLAM (CTG1B_HUMAN)
SLLLEFYLAI

SEQ ID NO: 32266 - protein, 11 aa, Artificial Sequence
  Description of Artificial Sequence: Synthetic peptide
  Seed: RLLEFYLAMPF (CTG1B_HUMAN)
RELEFYLAMPF

SEQ ID NO: 32267 - protein, 10 aa, Artificial Sequence
  Description of Artificial Sequence: Synthetic peptide
  Seed: GIPDGPGGNA (CTG1B_HUMAN)
GGPDGPGGNL

SEQ ID NO: 32268 - protein, 10 aa, Artificial Sequence
  Description of Artificial Sequence: Synthetic peptide
  Seed: SLLMWITQCF (CTG1B_HUMAN)
SKLMWITQCY

SEQ ID NO: 32269 - protein, 10 aa, Artificial Sequence
  Description of Artificial Sequence: Synthetic peptide
  Seed: LLEFYLAMPF (CTG1B_HUMAN)
LMEFYLAMPM

SEQ ID NO: 32270 - protein, 9 aa, Artificial Sequence
  Description of Artificial Sequence: Synthetic peptide
  Seed: FYLAMPFAT (CTG1B_HUMAN)
FFLAMPFAI

SEQ ID NO: 32271 - protein, 10 aa, Artificial Sequence
  Description of Artificial Sequence: Synthetic peptide
  Seed: SLAQDAPPLP (CTG1B_HUMAN)
SMAQDAPPLI

SEQ ID NO: 32272 - protein, 10 aa, Artificial Sequence
  Description of Artificial Sequence: Synthetic peptide
  Seed: RGPESRLLEF (CTG1B_HUMAN)
RRPESRLLEM

SEQ ID NO: 32273 - protein, 10 aa, Artificial Sequence
  Description of Artificial Sequence: Synthetic peptide
  Seed: TAADHRQLQL (CTG1B_HUMAN)
TYADHRQLQY

SEQ ID NO: 32274 - protein, 9 aa, Artificial Sequence
  Description of Artificial Sequence: Synthetic peptide
  Seed: ITQCFLPVF (CTG1B_HUMAN)
IAQCFLPVL

SEQ ID NO: 32275 - protein, 9 aa, Artificial Sequence
  Description of Artificial Sequence: Synthetic peptide
  Seed: KEFTVSGNI (CTG1B_HUMAN)
KEFTVSGNF

SEQ ID NO: 32276 - protein, 9 aa, Artificial Sequence
  Description of Artificial Sequence: Synthetic peptide
  Seed: LEFYLAMPF (CTG1B_HUMAN)
LIFYLAMPM

SEQ ID NO: 32277 - protein, 8 aa, Artificial Sequence
  Description of Artificial Sequence: Synthetic peptide
  Seed: MPFATPME (CTG1B_HUMAN)
MPFATPMF

SEQ ID NO: 32278 - protein, 10 aa, Artificial Sequence
  Description of Artificial Sequence: Synthetic peptide
  Seed: RGPESRLLEF (CTG1B_HUMAN)
RAPESRLLEF

SEQ ID NO: 32279 - protein, 11 aa, Artificial Sequence
  Description of Artificial Sequence: Synthetic peptide
  Seed: FLAQPPSGQRR (CTG1B_HUMAN)
FVAQPPSGQRK

SEQ ID NO: 32280 - protein, 11 aa, Artificial Sequence
  Description of Artificial Sequence: Synthetic peptide
  Seed: RQLQLSISSCL (CTG1B_HUMAN)
RKLQLSISSCF

SEQ ID NO: 32281 - protein, 10 aa, Artificial Sequence
  Description of Artificial Sequence: Synthetic peptide
  Seed: RSLAQDAPPL (CTG1B_HUMAN)
RGLAQDAPPW

SEQ ID NO: 32282 - protein, 9 aa, Artificial Sequence
  Description of Artificial Sequence: Synthetic peptide
  Seed: APPLPVPGV (CTG1B_HUMAN)
ASPLPVPGV

SEQ ID NO: 32283 - protein, 11 aa, Artificial Sequence
  Description of Artificial Sequence: Synthetic peptide
  Seed: APRGPHGGAAS (CTG1B_HUMAN)
APRGPHGGAAF

SEQ ID NO: 32284 - protein, 10 aa, Artificial Sequence
  Description of Artificial Sequence: Synthetic peptide
  Seed: LLEFYLAMPF (CTG1B_HUMAN)
LCEFYLAMPY

SEQ ID NO: 32285 - protein, 10 aa, Artificial Sequence
  Description of Artificial Sequence: Synthetic peptide
  Seed: YLAMPFATPM (CTG1B_HUMAN)
YPAMPFATPL

SEQ ID NO: 32286 - protein, 8 aa, Artificial Sequence
  Description of Artificial Sequence: Synthetic peptide
  Seed: RLLEFYLA (CTG1B_HUMAN)
RMLEFYLI

SEQ ID NO: 32287 - protein, 9 aa, Artificial Sequence
  Description of Artificial Sequence: Synthetic peptide
  Seed: LAMPFATPM (CTG1B_HUMAN)
LIMPFATPY

SEQ ID NO: 32288 - protein, 9 aa, Artificial Sequence
  Description of Artificial Sequence: Synthetic peptide
  Seed: FATPMEAEL (CTG1B_HUMAN)
FVTPMEAEM

SEQ ID NO: 32289 - protein, 9 aa, Artificial Sequence
  Description of Artificial Sequence: Synthetic peptide
  Seed: LLKEFTVSG (CTG1B_HUMAN)
LMKEFTVSI

SEQ ID NO: 32290 - protein, 9 aa, Artificial Sequence
  Description of Artificial Sequence: Synthetic peptide
  Seed: GPHGGAASG (CTG1B_HUMAN)
GPHGGAAST

SEQ ID NO: 32291 - protein, 10 aa, Artificial Sequence
  Description of Artificial Sequence: Synthetic peptide
  Seed: ISSCLQQLSL (CTG1B_HUMAN)
IYSCLQQLSW

SEQ ID NO: 32292 - protein, 10 aa, Artificial Sequence
  Description of Artificial Sequence: Synthetic peptide
  Seed: YLAMPFATPM (CTG1B_HUMAN)
YYAMPFATPA

SEQ ID NO: 32293 - protein, 9 aa, Artificial Sequence
  Description of Artificial Sequence: Synthetic peptide
  Seed: LPVPGVLLK (CTG1B_HUMAN)
LPVPGVLLA

SEQ ID NO: 32294 - protein, 9 aa, Artificial Sequence
  Description of Artificial Sequence: Synthetic peptide
  Seed: AQDAPPLPV (CTG1B_HUMAN)
AVDAPPLPY

SEQ ID NO: 32295 - protein, 10 aa, Artificial Sequence
  Description of Artificial Sequence: Synthetic peptide
  Seed: ASGPGGGAPR (CTG1B_HUMAN)
ASGPGGGAPM

SEQ ID NO: 32296 - protein, 10 aa, Artificial Sequence
  Description of Artificial Sequence: Synthetic peptide
  Seed: FLAQPPSGQR (CTG1B_HUMAN)
FAAQPPSGQL

SEQ ID NO: 32297 - protein, 9 aa, Artificial Sequence
  Description of Artificial Sequence: Synthetic peptide
  Seed: LPVPGVLLK (CTG1B_HUMAN)
LTVPGVLLV

SEQ ID NO: 32298 - protein, 10 aa, Artificial Sequence
  Description of Artificial Sequence: Synthetic peptide
  Seed: SRLLEFYLAM (CTG1B_HUMAN)
SSLLEFYLAV

SEQ ID NO: 32299 - protein, 9 aa, Artificial Sequence
  Description of Artificial Sequence: Synthetic peptide
  Seed: AARASGPGG (CTG1B_HUMAN)
ATRASGPGR

SEQ ID NO: 32300 - protein, 11 aa, Artificial Sequence
  Description of Artificial Sequence: Synthetic peptide
  Seed: AARASGPGGGA (CTG1B_HUMAN)
AARASGPGGGM

SEQ ID NO: 32301 - protein, 10 aa, Artificial Sequence
  Description of Artificial Sequence: Synthetic peptide
  Seed: FYLAMPFATP (CTG1B_HUMAN)
FHLAMPFATI

SEQ ID NO: 32302 - protein, 11 aa, Artificial Sequence
  Description of Artificial Sequence: Synthetic peptide
  Seed: GAPRGPHGGAA (CTG1B_HUMAN)
GTPRGPHGGAL

SEQ ID NO: 32303 - protein, 9 aa, Artificial Sequence
  Description of Artificial Sequence: Synthetic peptide
  Seed: LLKEFTVSG (CTG1B_HUMAN)
LLKEFTVSI

SEQ ID NO: 32304 - protein, 9 aa, Artificial Sequence
  Description of Artificial Sequence: Synthetic peptide
  Seed: MPFATPMEA (CTG1B_HUMAN)
MQFATPMEI

SEQ ID NO: 32305 - protein, 10 aa, Artificial Sequence
  Description of Artificial Sequence: Synthetic peptide
  Seed: MPFATPMEAE (CTG1B_HUMAN)
MPFATPMEAA

SEQ ID NO: 32306 - protein, 10 aa, Artificial Sequence
  Description of Artificial Sequence: Synthetic peptide
  Seed: MPFATPMEAE (CTG1B_HUMAN)
MPFATPMEAL

SEQ ID NO: 32307 - protein, 9 aa, Artificial Sequence
  Description of Artificial Sequence: Synthetic peptide
  Seed: AQDAPPLPV (CTG1B_HUMAN)
AVDAPPLPL

SEQ ID NO: 32308 - protein, 10 aa, Artificial Sequence
  Description of Artificial Sequence: Synthetic peptide
  Seed: FTVSGNILTI (CTG1B_HUMAN)
FAVSGNILTY

SEQ ID NO: 32309 - protein, 11 aa, Artificial Sequence
  Description of Artificial Sequence: Synthetic peptide
  Seed: RLLEFYLAMPF (CTG1B_HUMAN)
RVLEFYLAMPM

SEQ ID NO: 32310 - protein, 10 aa, Artificial Sequence
  Description of Artificial Sequence: Synthetic peptide
  Seed: RQLQLSISSC (CTG1B_HUMAN)
RELQLSISSI

SEQ ID NO: 32311 - protein, 9 aa, Artificial Sequence
  Description of Artificial Sequence: Synthetic peptide
  Seed: AQDAPPLPV (CTG1B_HUMAN)
ARDAPPLPF

SEQ ID NO: 32312 - protein, 10 aa, Artificial Sequence
  Description of Artificial Sequence: Synthetic peptide
  Seed: LLMWITQCFL (CTG1B_HUMAN)
LRMWITQCFV

SEQ ID NO: 32313 - protein, 10 aa, Artificial Sequence
  Description of Artificial Sequence: Synthetic peptide
  Seed: RGPHGGAASG (CTG1B_HUMAN)
RHPHGGAASA

SEQ ID NO: 32314 - protein, 10 aa, Artificial Sequence
  Description of Artificial Sequence: Synthetic peptide
  Seed: APPLPVPGVL (CTG1B_HUMAN)
AAPLPVPGVM

SEQ ID NO: 32315 - protein, 11 aa, Artificial Sequence
  Description of Artificial Sequence: Synthetic peptide
  Seed: RASGPGGGAPR (CTG1B_HUMAN)
RTSGPGGGAPF

SEQ ID NO: 32316 - protein, 9 aa, Artificial Sequence
  Description of Artificial Sequence: Synthetic peptide
  Seed: MPFATPMEA (CTG1B_HUMAN)
MGFATPMEF

SEQ ID NO: 32317 - protein, 10 aa, Artificial Sequence
  Description of Artificial Sequence: Synthetic peptide
  Seed: RGPHGGAASG (CTG1B_HUMAN)
RTPHGGAASL

SEQ ID NO: 32318 - protein, 9 aa, Artificial Sequence
  Description of Artificial Sequence: Synthetic peptide
  Seed: YLAMPFATP (CTG1B_HUMAN)
YLAMPFATI

SEQ ID NO: 32319 - protein, 9 aa, Artificial Sequence
  Description of Artificial Sequence: Synthetic peptide
  Seed: AQDAPPLPV (CTG1B_HUMAN)
AEDAPPLPL

SEQ ID NO: 32320 - protein, 11 aa, Artificial Sequence
  Description of Artificial Sequence: Synthetic peptide
  Seed: RASGPGGGAPR (CTG1B_HUMAN)
RTSGPGGGAPY

SEQ ID NO: 32321 - protein, 9 aa, Artificial Sequence
  Description of Artificial Sequence: Synthetic peptide
  Seed: SLLMWITQC (CTG1B_HUMAN)
SMLMWITQC

SEQ ID NO: 32322 - protein, 9 aa, Artificial Sequence
  Description of Artificial Sequence: Synthetic peptide
  Seed: SISSCLQQL (CTG1B_HUMAN)
SASSCLQQR

SEQ ID NO: 32323 - protein, 9 aa, Artificial Sequence
  Description of Artificial Sequence: Synthetic peptide
  Seed: SISSCLQQL (CTG1B_HUMAN)
SSSSCLQQF

SEQ ID NO: 32324 - protein, 11 aa, Artificial Sequence
  Description of Artificial Sequence: Synthetic peptide
  Seed: RASGPGGGAPR (CTG1B_HUMAN)
RASGPGGGAPI

SEQ ID NO: 32325 - protein, 9 aa, Artificial Sequence
  Description of Artificial Sequence: Synthetic peptide
  Seed: LLMWITQCF (CTG1B_HUMAN)
LAMWITQCL

SEQ ID NO: 32326 - protein, 9 aa, Artificial Sequence
  Description of Artificial Sequence: Synthetic peptide
  Seed: FYLAMPFAT (CTG1B_HUMAN)
FYLAMPFAV

SEQ ID NO: 32327 - protein, 10 aa, Artificial Sequence
  Description of Artificial Sequence: Synthetic peptide
  Seed: LLEFYLAMPF (CTG1B_HUMAN)
LYEFYLAMPL

SEQ ID NO: 32328 - protein, 9 aa, Artificial Sequence
  Description of Artificial Sequence: Synthetic peptide
  Seed: LEFYLAMPF (CTG1B_HUMAN)
LRFYLAMPM

SEQ ID NO: 32329 - protein, 11 aa, Artificial Sequence
  Description of Artificial Sequence: Synthetic peptide
  Seed: FYLAMPFATPM (CTG1B_HUMAN)
FQLAMPFATPY

SEQ ID NO: 32330 - protein, 9 aa, Artificial Sequence
  Description of Artificial Sequence: Synthetic peptide
  Seed: LEFYLAMPF (CTG1B_HUMAN)
LLFYLAMPM

SEQ ID NO: 32331 - protein, 9 aa, Artificial Sequence
  Description of Artificial Sequence: Synthetic peptide
  Seed: LEFYLAMPF (CTG1B_HUMAN)
LSFYLAMPY

SEQ ID NO: 32332 - protein, 10 aa, Artificial Sequence
  Description of Artificial Sequence: Synthetic peptide
  Seed: RGPHGGAASG (CTG1B_HUMAN)
RGPHGGAASA

SEQ ID NO: 32333 - protein, 10 aa, Artificial Sequence
  Description of Artificial Sequence: Synthetic peptide
  Seed: RLLEFYLAMP (CTG1B_HUMAN)
RNLEFYLAMV

SEQ ID NO: 32334 - protein, 10 aa, Artificial Sequence
  Description of Artificial Sequence: Synthetic peptide
  Seed: TPMEAELARR (CTG1B_HUMAN)
TWMEAELARR

SEQ ID NO: 32335 - protein, 10 aa, Artificial Sequence
  Description of Artificial Sequence: Synthetic peptide
  Seed: LLEFYLAMPF (CTG1B_HUMAN)
LREFYLAMPL

SEQ ID NO: 32336 - protein, 10 aa, Artificial Sequence
  Description of Artificial Sequence: Synthetic peptide
  Seed: ITQCFLPVFL (CTG1B_HUMAN)
IQQCFLPVFV

SEQ ID NO: 32337 - protein, 9 aa, Artificial Sequence
  Description of Artificial Sequence: Synthetic peptide
  Seed: LMWITQCFL (CTG1B_HUMAN)
LQWITQCFL

SEQ ID NO: 32338 - protein, 9 aa, Artificial Sequence
  Description of Artificial Sequence: Synthetic peptide
  Seed: IPDGPGGNA (CTG1B_HUMAN)
IVDGPGGNV

SEQ ID NO: 32339 - protein, 9 aa, Artificial Sequence
  Description of Artificial Sequence: Synthetic peptide
  Seed: LPVPGVLLK (CTG1B_HUMAN)
LAVPGVLLK

SEQ ID NO: 32340 - protein, 9 aa, Artificial Sequence
  Description of Artificial Sequence: Synthetic peptide
  Seed: LAMPFATPM (CTG1B_HUMAN)
LLMPFATPI

SEQ ID NO: 32341 - protein, 10 aa, Artificial Sequence
  Description of Artificial Sequence: Synthetic peptide
  Seed: RGPESRLLEF (CTG1B_HUMAN)
RWPESRLLEM

SEQ ID NO: 32342 - protein, 9 aa, Artificial Sequence
  Description of Artificial Sequence: Synthetic peptide
  Seed: LPVPGVLLK (CTG1B_HUMAN)
LTVPGVLLY

SEQ ID NO: 32343 - protein, 9 aa, Artificial Sequence
  Description of Artificial Sequence: Synthetic peptide
  Seed: LTAADHRQL (CTG1B_HUMAN)
LSAADHRQW

SEQ ID NO: 32344 - protein, 11 aa, Artificial Sequence
  Description of Artificial Sequence: Synthetic peptide
  Seed: FYLAMPFATPM (CTG1B_HUMAN)
FRLAMPFATPL

SEQ ID NO: 32345 - protein, 9 aa, Artificial Sequence
  Description of Artificial Sequence: Synthetic peptide
  Seed: FTVSGNILT (CTG1B_HUMAN)
FVVSGNILI

SEQ ID NO: 32346 - protein, 9 aa, Artificial Sequence
  Description of Artificial Sequence: Synthetic peptide
  Seed: SRLLEFYLA (CTG1B_HUMAN)
SRLLEFYLL

SEQ ID NO: 32347 - protein, 9 aa, Artificial Sequence
  Description of Artificial Sequence: Synthetic peptide
  Seed: FATPMEAEL (CTG1B_HUMAN)
FLTPMEAEL

SEQ ID NO: 32348 - protein, 10 aa, Artificial Sequence
  Description of Artificial Sequence: Synthetic peptide
  Seed: RSLAQDAPPL (CTG1B_HUMAN)
RILAQDAPPW

SEQ ID NO: 32349 - protein, 9 aa, Artificial Sequence
  Description of Artificial Sequence: Synthetic peptide
  Seed: SLAQDAPPL (CTG1B_HUMAN)
SVAQDAPPA

SEQ ID NO: 32350 - protein, 9 aa, Artificial Sequence
  Description of Artificial Sequence: Synthetic peptide
  Seed: AQDAPPLPV (CTG1B_HUMAN)
AQDAPPLPI

SEQ ID NO: 32351 - protein, 10 aa, Artificial Sequence
  Description of Artificial Sequence: Synthetic peptide
  Seed: LLMWITQCFL (CTG1B_HUMAN)
LIMWITQCFA

SEQ ID NO: 32352 - protein, 11 aa, Artificial Sequence
  Description of Artificial Sequence: Synthetic peptide
  Seed: KEFTVSGNILT (CTG1B_HUMAN)
KEFTVSGNILM

SEQ ID NO: 32353 - protein, 9 aa, Artificial Sequence
  Description of Artificial Sequence: Synthetic peptide
  Seed: APPLPVPGV (CTG1B_HUMAN)
AGPLPVPGM

SEQ ID NO: 32354 - protein, 10 aa, Artificial Sequence
  Description of Artificial Sequence: Synthetic peptide
  Seed: GLNGCCRCGA (CTG1B_HUMAN)
GMNGCCRCGV

SEQ ID NO: 32355 - protein, 9 aa, Artificial Sequence
  Description of Artificial Sequence: Synthetic peptide
  Seed: FATPMEAEL (CTG1B_HUMAN)
FSTPMEAEM

SEQ ID NO: 32356 - protein, 11 aa, Artificial Sequence
  Description of Artificial Sequence: Synthetic peptide
  Seed: MPFATPMEAEL (CTG1B_HUMAN)
MVFATPMEAEY

SEQ ID NO: 32357 - protein, 9 aa, Artificial Sequence
  Description of Artificial Sequence: Synthetic peptide
  Seed: TVSGNILTI (CTG1B_HUMAN)
TASGNILTM

SEQ ID NO: 32358 - protein, 9 aa, Artificial Sequence
  Description of Artificial Sequence: Synthetic peptide
  Seed: AARASGPGG (CTG1B_HUMAN)
AFRASGPGA

SEQ ID NO: 32359 - protein, 9 aa, Artificial Sequence
  Description of Artificial Sequence: Synthetic peptide
  Seed: FATPMEAEL (CTG1B_HUMAN)
FMTPMEAEL

SEQ ID NO: 32360 - protein, 11 aa, Artificial Sequence
  Description of Artificial Sequence: Synthetic peptide
  Seed: FYLAMPFATPM (CTG1B_HUMAN)
FMLAMPFATPF

SEQ ID NO: 32361 - protein, 10 aa, Artificial Sequence
  Description of Artificial Sequence: Synthetic peptide
  Seed: LEFYLAMPFA (CTG1B_HUMAN)
LQFYLAMPFS

SEQ ID NO: 32362 - protein, 10 aa, Artificial Sequence
  Description of Artificial Sequence: Synthetic peptide
  Seed: MWITQCFLPV (CTG1B_HUMAN)
MYITQCFLPW

SEQ ID NO: 32363 - protein, 10 aa, Artificial Sequence
  Description of Artificial Sequence: Synthetic peptide
  Seed: RGPESRLLEF (CTG1B_HUMAN)
RRPESRLLEF

SEQ ID NO: 32364 - protein, 8 aa, Artificial Sequence
  Description of Artificial Sequence: Synthetic peptide
  Seed: TAADHRQL (CTG1B_HUMAN)
TAADHRQF

SEQ ID NO: 32365 - protein, 9 aa, Artificial Sequence
  Description of Artificial Sequence: Synthetic peptide
  Seed: LEFYLAMPF (CTG1B_HUMAN)
LGFYLAMPY

SEQ ID NO: 32366 - protein, 9 aa, Artificial Sequence
  Description of Artificial Sequence: Synthetic peptide
  Seed: CLQQLSLLM (CTG1B_HUMAN)
CMQQLSLLM

SEQ ID NO: 32367 - protein, 10 aa, Artificial Sequence
  Description of Artificial Sequence: Synthetic peptide
  Seed: SRLLEFYLAM (CTG1B_HUMAN)
SSLLEFYLAL

SEQ ID NO: 32368 - protein, 9 aa, Artificial Sequence
  Description of Artificial Sequence: Synthetic peptide
  Seed: TQCFLPVFL (CTG1B_HUMAN)
TLCFLPVFV

SEQ ID NO: 32369 - protein, 11 aa, Artificial Sequence
  Description of Artificial Sequence: Synthetic peptide
  Seed: YLAMPFATPME (CTG1B_HUMAN)
YMAMPFATPMI

SEQ ID NO: 32370 - protein, 9 aa, Artificial Sequence
  Description of Artificial Sequence: Synthetic peptide
  Seed: AQDAPPLPV (CTG1B_HUMAN)
AWDAPPLPL

SEQ ID NO: 32371 - protein, 9 aa, Artificial Sequence
  Description of Artificial Sequence: Synthetic peptide
  Seed: LQLSISSCL (CTG1B_HUMAN)
LVLSISSCY

SEQ ID NO: 32372 - protein, 10 aa, Artificial Sequence
  Description of Artificial Sequence: Synthetic peptide
  Seed: ITQCFLPVFL (CTG1B_HUMAN)
ILQCFLPVFM

SEQ ID NO: 32373 - protein, 9 aa, Artificial Sequence
  Description of Artificial Sequence: Synthetic peptide
  Seed: SGPGGGAPR (CTG1B_HUMAN)
SLPGGGAPY

SEQ ID NO: 32374 - protein, 10 aa, Artificial Sequence
  Description of Artificial Sequence: Synthetic peptide
  Seed: WITQCFLPVF (CTG1B_HUMAN)
WSTQCFLPVW

SEQ ID NO: 32375 - protein, 9 aa, Artificial Sequence
  Description of Artificial Sequence: Synthetic peptide
  Seed: MPFATPMEA (CTG1B_HUMAN)
MCFATPMEF

SEQ ID NO: 32376 - protein, 10 aa, Artificial Sequence
  Description of Artificial Sequence: Synthetic peptide
  Seed: SRLLEFYLAM (CTG1B_HUMAN)
SFLLEFYLAL

SEQ ID NO: 32377 - protein, 10 aa, Artificial Sequence
  Description of Artificial Sequence: Synthetic peptide
  Seed: LLEFYLAMPF (CTG1B_HUMAN)
LWEFYLAMPW

SEQ ID NO: 32378 - protein, 9 aa, Artificial Sequence
  Description of Artificial Sequence: Synthetic peptide
  Seed: AARASGPGG (CTG1B_HUMAN)
ATRASGPGC

SEQ ID NO: 32379 - protein, 10 aa, Artificial Sequence
  Description of Artificial Sequence: Synthetic peptide
  Seed: FYLAMPFATP (CTG1B_HUMAN)
FVLAMPFATV

SEQ ID NO: 32380 - protein, 11 aa, Artificial Sequence
  Description of Artificial Sequence: Synthetic peptide
  Seed: RLLEFYLAMPF (CTG1B_HUMAN)
RDLEFYLAMPF

SEQ ID NO: 32381 - protein, 10 aa, Artificial Sequence
  Description of Artificial Sequence: Synthetic peptide
  Seed: LLEFYLAMPF (CTG1B_HUMAN)
LHEFYLAMPF

SEQ ID NO: 32382 - protein, 11 aa, Artificial Sequence
  Description of Artificial Sequence: Synthetic peptide
  Seed: RLLEFYLAMPF (CTG1B_HUMAN)
RYLEFYLAMPY

SEQ ID NO: 32383 - protein, 10 aa, Artificial Sequence
  Description of Artificial Sequence: Synthetic peptide
  Seed: RGPESRLLEF (CTG1B_HUMAN)
RVPESRLLEY

SEQ ID NO: 32384 - protein, 10 aa, Artificial Sequence
  Description of Artificial Sequence: Synthetic peptide
  Seed: TVSGNILTIR (CTG1B_HUMAN)
TFSGNILTIR

SEQ ID NO: 32385 - protein, 9 aa, Artificial Sequence
  Description of Artificial Sequence: Synthetic peptide
  Seed: TVSGNILTI (CTG1B_HUMAN)
TMSGNILTF

SEQ ID NO: 32386 - protein, 9 aa, Artificial Sequence
  Description of Artificial Sequence: Synthetic peptide
  Seed: FATPMEAEL (CTG1B_HUMAN)
FSTPMEAEL

SEQ ID NO: 32387 - protein, 10 aa, Artificial Sequence
  Description of Artificial Sequence: Synthetic peptide
  Seed: GAPRGPHGGA (CTG1B_HUMAN)
GPPRGPHGGM

SEQ ID NO: 32388 - protein, 9 aa, Artificial Sequence
  Description of Artificial Sequence: Synthetic peptide
  Seed: QQLSLLMWI (CTG1B_HUMAN)
QILSLLMWL

SEQ ID NO: 32389 - protein, 10 aa, Artificial Sequence
  Description of Artificial Sequence: Synthetic peptide
  Seed: FTVSGNILTI (CTG1B_HUMAN)
FIVSGNILTV

SEQ ID NO: 32390 - protein, 10 aa, Artificial Sequence
  Description of Artificial Sequence: Synthetic peptide
  Seed: FYLAMPFATP (CTG1B_HUMAN)
FTLAMPFATM

SEQ ID NO: 32391 - protein, 9 aa, Artificial Sequence
  Description of Artificial Sequence: Synthetic peptide
  Seed: MQAEGRGTG (CTG1B_HUMAN)
MEAEGRGTM

SEQ ID NO: 32392 - protein, 11 aa, Artificial Sequence
  Description of Artificial Sequence: Synthetic peptide
  Seed: FYLAMPFATPM (CTG1B_HUMAN)
FNLAMPFATPL

SEQ ID NO: 32393 - protein, 10 aa, Artificial Sequence
  Description of Artificial Sequence: Synthetic peptide
  Seed: FLPVFLAQPP (CTG1B_HUMAN)
FSPVFLAQPA

SEQ ID NO: 32394 - protein, 9 aa, Artificial Sequence
  Description of Artificial Sequence: Synthetic peptide
  Seed: TVSGNILTI (CTG1B_HUMAN)
TLSGNILTW

SEQ ID NO: 32395 - protein, 9 aa, Artificial Sequence
  Description of Artificial Sequence: Synthetic peptide
  Seed: SISSCLQQL (CTG1B_HUMAN)
SVSSCLQQY

SEQ ID NO: 32396 - protein, 9 aa, Artificial Sequence
  Description of Artificial Sequence: Synthetic peptide
  Seed: IPDGPGGNA (CTG1B_HUMAN)
IGDGPGGNL

SEQ ID NO: 32397 - protein, 11 aa, Artificial Sequence
  Description of Artificial Sequence: Synthetic peptide
  Seed: RLLEFYLAMPF (CTG1B_HUMAN)
RFLEFYLAMPL

SEQ ID NO: 32398 - protein, 10 aa, Artificial Sequence
  Description of Artificial Sequence: Synthetic peptide
  Seed: FLPVFLAQPP (CTG1B_HUMAN)
FFPVFLAQPA

SEQ ID NO: 32399 - protein, 9 aa, Artificial Sequence
  Description of Artificial Sequence: Synthetic peptide
  Seed: LQLSISSCL (CTG1B_HUMAN)
LHLSISSCL

SEQ ID NO: 32400 - protein, 9 aa, Artificial Sequence
  Description of Artificial Sequence: Synthetic peptide
  Seed: LAQPPSGQR (CTG1B_HUMAN)
LIQPPSGQR

SEQ ID NO: 32401 - protein, 10 aa, Artificial Sequence
  Description of Artificial Sequence: Synthetic peptide
  Seed: LLEFYLAMPF (CTG1B_HUMAN)
LDEFYLAMPY

SEQ ID NO: 32402 - protein, 10 aa, Artificial Sequence
  Description of Artificial Sequence: Synthetic peptide
  Seed: RSLAQDAPPL (CTG1B_HUMAN)
RKLAQDAPPV

SEQ ID NO: 32403 - protein, 9 aa, Artificial Sequence
  Description of Artificial Sequence: Synthetic peptide
  Seed: LAMPFATPM (CTG1B_HUMAN)
LCMPFATPW

SEQ ID NO: 32404 - protein, 10 aa, Artificial Sequence
  Description of Artificial Sequence: Synthetic peptide
  Seed: LSISSCLQQL (CTG1B_HUMAN)
LSISSCLQQY

SEQ ID NO: 32405 - protein, 9 aa, Artificial Sequence
  Description of Artificial Sequence: Synthetic peptide
  Seed: AARASGPGG (CTG1B_HUMAN)
AARASGPGI

SEQ ID NO: 32406 - protein, 9 aa, Artificial Sequence
  Description of Artificial Sequence: Synthetic peptide
  Seed: RQLQLSISS (CTG1B_HUMAN)
RILQLSISM

SEQ ID NO: 32407 - protein, 9 aa, Artificial Sequence
  Description of Artificial Sequence: Synthetic peptide
  Seed: LAMPFATPM (CTG1B_HUMAN)
LHMPFATPF

SEQ ID NO: 32408 - protein, 10 aa, Artificial Sequence
  Description of Artificial Sequence: Synthetic peptide
  Seed: SRLLEFYLAM (CTG1B_HUMAN)
SLLLEFYLAL

SEQ ID NO: 32409 - protein, 10 aa, Artificial Sequence
  Description of Artificial Sequence: Synthetic peptide
  Seed: FYLAMPFATP (CTG1B_HUMAN)
FRLAMPFATM

SEQ ID NO: 32410 - protein, 11 aa, Artificial Sequence
  Description of Artificial Sequence: Synthetic peptide
  Seed: IPDGPGGNAGG (CTG1B_HUMAN)
IPDGPGGNAGL

SEQ ID NO: 32411 - protein, 11 aa, Artificial Sequence
  Description of Artificial Sequence: Synthetic peptide
  Seed: GAPRGPHGGAA (CTG1B_HUMAN)
GRPRGPHGGAL

SEQ ID NO: 32412 - protein, 9 aa, Artificial Sequence
  Description of Artificial Sequence: Synthetic peptide
  Seed: LMWITQCFL (CTG1B_HUMAN)
LHWITQCFY

SEQ ID NO: 32413 - protein, 9 aa, Artificial Sequence
  Description of Artificial Sequence: Synthetic peptide
  Seed: RLLEFYLAM (CTG1B_HUMAN)
RILEFYLAR

SEQ ID NO: 32414 - protein, 9 aa, Artificial Sequence
  Description of Artificial Sequence: Synthetic peptide
  Seed: LEFYLAMPF (CTG1B_HUMAN)
LQFYLAMPH

SEQ ID NO: 32415 - protein, 9 aa, Artificial Sequence
  Description of Artificial Sequence: Synthetic peptide
  Seed: RLLEFYLAM (CTG1B_HUMAN)
RALEFYLAL

SEQ ID NO: 32416 - protein, 10 aa, Artificial Sequence
  Description of Artificial Sequence: Synthetic peptide
  Seed: RSLAQDAPPL (CTG1B_HUMAN)
RNLAQDAPPV

SEQ ID NO: 32417 - protein, 9 aa, Artificial Sequence
  Description of Artificial Sequence: Synthetic peptide
  Seed: AQDAPPLPV (CTG1B_HUMAN)
AIDAPPLPV

SEQ ID NO: 32418 - protein, 11 aa, Artificial Sequence
  Description of Artificial Sequence: Synthetic peptide
  Seed: FYLAMPFATPM (CTG1B_HUMAN)
FFLAMPFATPV

SEQ ID NO: 32419 - protein, 9 aa, Artificial Sequence
  Description of Artificial Sequence: Synthetic peptide
  Seed: TVSGNILTI (CTG1B_HUMAN)
TSSGNILTL

SEQ ID NO: 32420 - protein, 9 aa, Artificial Sequence
  Description of Artificial Sequence: Synthetic peptide
  Seed: LAQPPSGQR (CTG1B_HUMAN)
LTQPPSGQF

SEQ ID NO: 32421 - protein, 9 aa, Artificial Sequence
  Description of Artificial Sequence: Synthetic peptide
  Seed: FLPVFLAQP (CTG1B_HUMAN)
FMPVFLAQI

SEQ ID NO: 32422 - protein, 11 aa, Artificial Sequence
  Description of Artificial Sequence: Synthetic peptide
  Seed: RASGPGGGAPR (CTG1B_HUMAN)
RSSGPGGGAPF

SEQ ID NO: 32423 - protein, 9 aa, Artificial Sequence
  Description of Artificial Sequence: Synthetic peptide
  Seed: SSCLQQLSL (CTG1B_HUMAN)
SMCLQQLSW

SEQ ID NO: 32424 - protein, 9 aa, Artificial Sequence
  Description of Artificial Sequence: Synthetic peptide
  Seed: LLMWITQCF (CTG1B_HUMAN)
LMMWITQCM

SEQ ID NO: 32425 - protein, 10 aa, Artificial Sequence
  Description of Artificial Sequence: Synthetic peptide
  Seed: APRGPHGGAA (CTG1B_HUMAN)
AARGPHGGAM

SEQ ID NO: 32426 - protein, 11 aa, Artificial Sequence
  Description of Artificial Sequence: Synthetic peptide
  Seed: YLAMPFATPME (CTG1B_HUMAN)
YLAMPFATPMA

SEQ ID NO: 32427 - protein, 9 aa, Artificial Sequence
  Description of Artificial Sequence: Synthetic peptide
  Seed: LPVFLAQPP (CTG1B_HUMAN)
LPVFLAQPV

SEQ ID NO: 32428 - protein, 9 aa, Artificial Sequence
  Description of Artificial Sequence: Synthetic peptide
  Seed: LQLSISSCL (CTG1B_HUMAN)
LHLSISSCF

SEQ ID NO: 32429 - protein, 10 aa, Artificial Sequence
  Description of Artificial Sequence: Synthetic peptide
  Seed: AMPFATPMEA (CTG1B_HUMAN)
AFPFATPMEA

SEQ ID NO: 32430 - protein, 9 aa, Artificial Sequence
  Description of Artificial Sequence: Synthetic peptide
  Seed: SSCLQQLSL (CTG1B_HUMAN)
SMCLQQLSF

SEQ ID NO: 32431 - protein, 10 aa, Artificial Sequence
  Description of Artificial Sequence: Synthetic peptide
  Seed: RQLQLSISSC (CTG1B_HUMAN)
RELQLSISSC

SEQ ID NO: 32432 - protein, 9 aa, Artificial Sequence
  Description of Artificial Sequence: Synthetic peptide
  Seed: TPMEAELAR (CTG1B_HUMAN)
TPMEAELAL

SEQ ID NO: 32433 - protein, 9 aa, Artificial Sequence
  Description of Artificial Sequence: Synthetic peptide
  Seed: AQDAPPLPV (CTG1B_HUMAN)
AADAPPLPL

SEQ ID NO: 32434 - protein, 9 aa, Artificial Sequence
  Description of Artificial Sequence: Synthetic peptide
  Seed: LMWITQCFL (CTG1B_HUMAN)
LLWITQCFV

SEQ ID NO: 32435 - protein, 10 aa, Artificial Sequence
  Description of Artificial Sequence: Synthetic peptide
  Seed: GIPDGPGGNA (CTG1B_HUMAN)
GSPDGPGGNY

SEQ ID NO: 32436 - protein, 9 aa, Artificial Sequence
  Description of Artificial Sequence: Synthetic peptide
  Seed: LEFYLAMPF (CTG1B_HUMAN)
LMFYLAMPI

SEQ ID NO: 32437 - protein, 9 aa, Artificial Sequence
  Description of Artificial Sequence: Synthetic peptide
  Seed: SRLLEFYLA (CTG1B_HUMAN)
SRLLEFYLK

SEQ ID NO: 32438 - protein, 9 aa, Artificial Sequence
  Description of Artificial Sequence: Synthetic peptide
  Seed: MPFATPMEA (CTG1B_HUMAN)
MLFATPMEY

SEQ ID NO: 32439 - protein, 9 aa, Artificial Sequence
  Description of Artificial Sequence: Synthetic peptide
  Seed: TVSGNILTI (CTG1B_HUMAN)
TLSGNILTF

SEQ ID NO: 32440 - protein, 10 aa, Artificial Sequence
  Description of Artificial Sequence: Synthetic peptide
  Seed: LLMWITQCFL (CTG1B_HUMAN)
LAMWITQCFV

SEQ ID NO: 32441 - protein, 9 aa, Artificial Sequence
  Description of Artificial Sequence: Synthetic peptide
  Seed: LEFYLAMPF (CTG1B_HUMAN)
LVFYLAMPY

SEQ ID NO: 32442 - protein, 9 aa, Artificial Sequence
  Description of Artificial Sequence: Synthetic peptide
  Seed: CLQQLSLLM (CTG1B_HUMAN)
CMQQLSLLF

SEQ ID NO: 32443 - protein, 10 aa, Artificial Sequence
  Description of Artificial Sequence: Synthetic peptide
  Seed: LLEFYLAMPF (CTG1B_HUMAN)
LPEFYLAMPW

SEQ ID NO: 32444 - protein, 10 aa, Artificial Sequence
  Description of Artificial Sequence: Synthetic peptide
  Seed: TVSGNILTIR (CTG1B_HUMAN)
TTSGNILTIR

SEQ ID NO: 32445 - protein, 9 aa, Artificial Sequence
  Description of Artificial Sequence: Synthetic peptide
  Seed: SGPGGGAPR (CTG1B_HUMAN)
STPGGGAPY

SEQ ID NO: 32446 - protein, 9 aa, Artificial Sequence
  Description of Artificial Sequence: Synthetic peptide
  Seed: MPFATPMEA (CTG1B_HUMAN)
MHFATPMET

SEQ ID NO: 32447 - protein, 10 aa, Artificial Sequence
  Description of Artificial Sequence: Synthetic peptide
  Seed: FYLAMPFATP (CTG1B_HUMAN)
FNLAMPFATA

SEQ ID NO: 32448 - protein, 10 aa, Artificial Sequence
  Description of Artificial Sequence: Synthetic peptide
  Seed: GAPRGPHGGA (CTG1B_HUMAN)
GDPRGPHGGM

SEQ ID NO: 32449 - protein, 10 aa, Artificial Sequence
  Description of Artificial Sequence: Synthetic peptide
  Seed: EFTVSGNILT (CTG1B_HUMAN)
ETTVSGNILI

SEQ ID NO: 32450 - protein, 9 aa, Artificial Sequence
  Description of Artificial Sequence: Synthetic peptide
  Seed: AADHRQLQL (CTG1B_HUMAN)
ASDHRQLQW

SEQ ID NO: 32451 - protein, 11 aa, Artificial Sequence
  Description of Artificial Sequence: Synthetic peptide
  Seed: APRGPHGGAAS (CTG1B_HUMAN)
APRGPHGGAAG

SEQ ID NO: 32452 - protein, 11 aa, Artificial Sequence
  Description of Artificial Sequence: Synthetic peptide
  Seed: RLLEFYLAMPF (CTG1B_HUMAN)
RHLEFYLAMPM

SEQ ID NO: 32453 - protein, 10 aa, Artificial Sequence
  Description of Artificial Sequence: Synthetic peptide
  Seed: VSGNILTIRL (CTG1B_HUMAN)
VTGNILTIRW

SEQ ID NO: 32454 - protein, 9 aa, Artificial Sequence
  Description of Artificial Sequence: Synthetic peptide
  Seed: QQLSLLMWI (CTG1B_HUMAN)
QMLSLLMWM

SEQ ID NO: 32455 - protein, 11 aa, Artificial Sequence
  Description of Artificial Sequence: Synthetic peptide
  Seed: ISSCLQQLSLL (CTG1B_HUMAN)
ISSCLQQLSLF

SEQ ID NO: 32456 - protein, 9 aa, Artificial Sequence
  Description of Artificial Sequence: Synthetic peptide
  Seed: RLLEFYLAM (CTG1B_HUMAN)
RTLEFYLAK

SEQ ID NO: 32457 - protein, 10 aa, Artificial Sequence
  Description of Artificial Sequence: Synthetic peptide
  Seed: YLAMPFATPM (CTG1B_HUMAN)
YCAMPFATPW

SEQ ID NO: 32458 - protein, 10 aa, Artificial Sequence
  Description of Artificial Sequence: Synthetic peptide
  Seed: RGPESRLLEF (CTG1B_HUMAN)
RPPESRLLEF

SEQ ID NO: 32459 - protein, 9 aa, Artificial Sequence
  Description of Artificial Sequence: Synthetic peptide
  Seed: RLLEFYLAM (CTG1B_HUMAN)
RRLEFYLAL

SEQ ID NO: 32460 - protein, 10 aa, Artificial Sequence
  Description of Artificial Sequence: Synthetic peptide
  Seed: SSCLQQLSLL (CTG1B_HUMAN)
STCLQQLSLW

SEQ ID NO: 32461 - protein, 9 aa, Artificial Sequence
  Description of Artificial Sequence: Synthetic peptide
  Seed: IPDGPGGNA (CTG1B_HUMAN)
IIDGPGGNI

SEQ ID NO: 32462 - protein, 9 aa, Artificial Sequence
  Description of Artificial Sequence: Synthetic peptide
  Seed: AARASGPGG (CTG1B_HUMAN)
AGRASGPGK

SEQ ID NO: 32463 - protein, 10 aa, Artificial Sequence
  Description of Artificial Sequence: Synthetic peptide
  Seed: LEFYLAMPFA (CTG1B_HUMAN)
LQFYLAMPFH

SEQ ID NO: 32464 - protein, 10 aa, Artificial Sequence
  Description of Artificial Sequence: Synthetic peptide
  Seed: YLAMPFATPM (CTG1B_HUMAN)
YRAMPFATPW

SEQ ID NO: 32465 - protein, 9 aa, Artificial Sequence
  Description of Artificial Sequence: Synthetic peptide
  Seed: FATPMEAEL (CTG1B_HUMAN)
FTTPMEAEY

SEQ ID NO: 32466 - protein, 9 aa, Artificial Sequence
  Description of Artificial Sequence: Synthetic peptide
  Seed: ITQCFLPVF (CTG1B_HUMAN)
IYQCFLPVF

SEQ ID NO: 32467 - protein, 10 aa, Artificial Sequence
  Description of Artificial Sequence: Synthetic peptide
  Seed: SRLLEFYLAM (CTG1B_HUMAN)
STLLEFYLAM

SEQ ID NO: 32468 - protein, 10 aa, Artificial Sequence
  Description of Artificial Sequence: Synthetic peptide
  Seed: FLPVFLAQPP (CTG1B_HUMAN)
FIPVFLAQPA

SEQ ID NO: 32469 - protein, 11 aa, Artificial Sequence
  Description of Artificial Sequence: Synthetic peptide
  Seed: FYLAMPFATPM (CTG1B_HUMAN)
FTLAMPFATPI

SEQ ID NO: 32470 - protein, 10 aa, Artificial Sequence
  Description of Artificial Sequence: Synthetic peptide
  Seed: RGPHGGAASG (CTG1B_HUMAN)
RDPHGGAASM

SEQ ID NO: 32471 - protein, 10 aa, Artificial Sequence
  Description of Artificial Sequence: Synthetic peptide
  Seed: ASGPGGGAPR (CTG1B_HUMAN)
ALGPGGGAPY

SEQ ID NO: 32472 - protein, 10 aa, Artificial Sequence
  Description of Artificial Sequence: Synthetic peptide
  Seed: SRLLEFYLAM (CTG1B_HUMAN)
SKLLEFYLAF

SEQ ID NO: 32473 - protein, 10 aa, Artificial Sequence
  Description of Artificial Sequence: Synthetic peptide
  Seed: GIPDGPGGNA (CTG1B_HUMAN)
GTPDGPGGNY

SEQ ID NO: 32474 - protein, 10 aa, Artificial Sequence
  Description of Artificial Sequence: Synthetic peptide
  Seed: RGPHGGAASG (CTG1B_HUMAN)
RQPHGGAASL

SEQ ID NO: 32475 - protein, 10 aa, Artificial Sequence
  Description of Artificial Sequence: Synthetic peptide
  Seed: FLAQPPSGQR (CTG1B_HUMAN)
FAAQPPSGQR

SEQ ID NO: 32476 - protein, 9 aa, Artificial Sequence
  Description of Artificial Sequence: Synthetic peptide
  Seed: ILTIRLTAA (CTG1B_HUMAN)
IITIRLTAV

SEQ ID NO: 32477 - protein, 10 aa, Artificial Sequence
  Description of Artificial Sequence: Synthetic peptide
  Seed: YLAMPFATPM (CTG1B_HUMAN)
YRAMPFATPV

SEQ ID NO: 32478 - protein, 10 aa, Artificial Sequence
  Description of Artificial Sequence: Synthetic peptide
  Seed: RASGPGGGAP (CTG1B_HUMAN)
RVSGPGGGAF

SEQ ID NO: 32479 - protein, 10 aa, Artificial Sequence
  Description of Artificial Sequence: Synthetic peptide
  Seed: FYLAMPFATP (CTG1B_HUMAN)
FALAMPFATM

SEQ ID NO: 32480 - protein, 10 aa, Artificial Sequence
  Description of Artificial Sequence: Synthetic peptide
  Seed: FTVSGNILTI (CTG1B_HUMAN)
FFVSGNILTV

SEQ ID NO: 32481 - protein, 10 aa, Artificial Sequence
  Description of Artificial Sequence: Synthetic peptide
  Seed: FTVSGNILTI (CTG1B_HUMAN)
FYVSGNILTV

SEQ ID NO: 32482 - protein, 10 aa, Artificial Sequence
  Description of Artificial Sequence: Synthetic peptide
  Seed: YLAMPFATPM (CTG1B_HUMAN)
YWAMPFATPF

SEQ ID NO: 32483 - protein, 9 aa, Artificial Sequence
  Description of Artificial Sequence: Synthetic peptide
  Seed: TAADHRQLQ (CTG1B_HUMAN)
TLADHRQLY

SEQ ID NO: 32484 - protein, 10 aa, Artificial Sequence
  Description of Artificial Sequence: Synthetic peptide
  Seed: RGPHGGAASG (CTG1B_HUMAN)
RYPHGGAASI

SEQ ID NO: 32485 - protein, 10 aa, Artificial Sequence
  Description of Artificial Sequence: Synthetic peptide
  Seed: YLAMPFATPM (CTG1B_HUMAN)
YKAMPFATPF

SEQ ID NO: 32486 - protein, 10 aa, Artificial Sequence
  Description of Artificial Sequence: Synthetic peptide
  Seed: LLMWITQCFL (CTG1B_HUMAN)
LYMWITQCFL

SEQ ID NO: 32487 - protein, 9 aa, Artificial Sequence
  Description of Artificial Sequence: Synthetic peptide
  Seed: LPVFLAQPP (CTG1B_HUMAN)
LSVFLAQPF

SEQ ID NO: 32488 - protein, 9 aa, Artificial Sequence
  Description of Artificial Sequence: Synthetic peptide
  Seed: SCLQQLSLL (CTG1B_HUMAN)
SSLQQLSLV

SEQ ID NO: 32489 - protein, 9 aa, Artificial Sequence
  Description of Artificial Sequence: Synthetic peptide
  Seed: SGPGGGAPR (CTG1B_HUMAN)
SYPGGGAPF

SEQ ID NO: 32490 - protein, 11 aa, Artificial Sequence
  Description of Artificial Sequence: Synthetic peptide
  Seed: LAMPFATPMEA (CTG1B_HUMAN)
LPMPFATPMEV

SEQ ID NO: 32491 - protein, 9 aa, Artificial Sequence
  Description of Artificial Sequence: Synthetic peptide
  Seed: FTVSGNILT (CTG1B_HUMAN)
FVVSGNILV

SEQ ID NO: 32492 - protein, 10 aa, Artificial Sequence
  Description of Artificial Sequence: Synthetic peptide
  Seed: LLEFYLAMPF (CTG1B_HUMAN)
LQEFYLAMPM

SEQ ID NO: 32493 - protein, 9 aa, Artificial Sequence
  Description of Artificial Sequence: Synthetic peptide
  Seed: RQLQLSISS (CTG1B_HUMAN)
RVLQLSISY

SEQ ID NO: 32494 - protein, 10 aa, Artificial Sequence
  Description of Artificial Sequence: Synthetic peptide
  Seed: YLAMPFATPM (CTG1B_HUMAN)
YIAMPFATPI

SEQ ID NO: 32495 - protein, 9 aa, Artificial Sequence
  Description of Artificial Sequence: Synthetic peptide
  Seed: LAMPFATPM (CTG1B_HUMAN)
LIMPFATPV

SEQ ID NO: 32496 - protein, 9 aa, Artificial Sequence
  Description of Artificial Sequence: Synthetic peptide
  Seed: MPFATPMEA (CTG1B_HUMAN)
MIFATPMEV

SEQ ID NO: 32497 - protein, 9 aa, Artificial Sequence
  Description of Artificial Sequence: Synthetic peptide
  Seed: RLLEFYLAM (CTG1B_HUMAN)
RLLEFYLAV

SEQ ID NO: 32498 - protein, 11 aa, Artificial Sequence
  Description of Artificial Sequence: Synthetic peptide
  Seed: RLLEFYLAMPF (CTG1B_HUMAN)
RSLEFYLAMPY

SEQ ID NO: 32499 - protein, 10 aa, Artificial Sequence
  Description of Artificial Sequence: Synthetic peptide
  Seed: APPLPVPGVL (CTG1B_HUMAN)
APPLPVPGVF

SEQ ID NO: 32500 - protein, 11 aa, Artificial Sequence
  Description of Artificial Sequence: Synthetic peptide
  Seed: NAGGPGEAGAT (CTG1B_HUMAN)
NAGGPGEAGAM

SEQ ID NO: 32501 - protein, 9 aa, Artificial Sequence
  Description of Artificial Sequence: Synthetic peptide
  Seed: QQLSLLMWI (CTG1B_HUMAN)
QQLSLLMWY

SEQ ID NO: 32502 - protein, 10 aa, Artificial Sequence
  Description of Artificial Sequence: Synthetic peptide
  Seed: RGPESRLLEF (CTG1B_HUMAN)
RKPESRLLEM

SEQ ID NO: 32503 - protein, 9 aa, Artificial Sequence
  Description of Artificial Sequence: Synthetic peptide
  Seed: LAMPFATPM (CTG1B_HUMAN)
LFMPFATPI

SEQ ID NO: 32504 - protein, 10 aa, Artificial Sequence
  Description of Artificial Sequence: Synthetic peptide
  Seed: AMPFATPMEA (CTG1B_HUMAN)
AMPFATPMEL

SEQ ID NO: 32505 - protein, 10 aa, Artificial Sequence
  Description of Artificial Sequence: Synthetic peptide
  Seed: FYLAMPFATP (CTG1B_HUMAN)
FELAMPFATM

SEQ ID NO: 32506 - protein, 11 aa, Artificial Sequence
  Description of Artificial Sequence: Synthetic peptide
  Seed: RLLEFYLAMPF (CTG1B_HUMAN)
RLLEFYLAMPL

SEQ ID NO: 32507 - protein, 9 aa, Artificial Sequence
  Description of Artificial Sequence: Synthetic peptide
  Seed: MPFATPMEA (CTG1B_HUMAN)
MHFATPMEL

SEQ ID NO: 32508 - protein, 10 aa, Artificial Sequence
  Description of Artificial Sequence: Synthetic peptide
  Seed: ASGPGGGAPR (CTG1B_HUMAN)
AIGPGGGAPR

SEQ ID NO: 32509 - protein, 10 aa, Artificial Sequence
  Description of Artificial Sequence: Synthetic peptide
  Seed: YLAMPFATPM (CTG1B_HUMAN)
YWAMPFATPA

SEQ ID NO: 32510 - protein, 10 aa, Artificial Sequence
  Description of Artificial Sequence: Synthetic peptide
  Seed: RGPHGGAASG (CTG1B_HUMAN)
REPHGGAASM

SEQ ID NO: 32511 - protein, 10 aa, Artificial Sequence
  Description of Artificial Sequence: Synthetic peptide
  Seed: GPHGGAASGL (CTG1B_HUMAN)
GPHGGAASGM

SEQ ID NO: 32512 - protein, 10 aa, Artificial Sequence
  Description of Artificial Sequence: Synthetic peptide
  Seed: YLAMPFATPM (CTG1B_HUMAN)
YEAMPFATPL

SEQ ID NO: 32513 - protein, 9 aa, Artificial Sequence
  Description of Artificial Sequence: Synthetic peptide
  Seed: AADHRQLQL (CTG1B_HUMAN)
ATDHRQLQY

SEQ ID NO: 32514 - protein, 10 aa, Artificial Sequence
  Description of Artificial Sequence: Synthetic peptide
  Seed: LPVFLAQPPS (CTG1B_HUMAN)
LPVFLAQPPV

SEQ ID NO: 32515 - protein, 10 aa, Artificial Sequence
  Description of Artificial Sequence: Synthetic peptide
  Seed: GAPRGPHGGA (CTG1B_HUMAN)
GAPRGPHGGM

SEQ ID NO: 32516 - protein, 10 aa, Artificial Sequence
  Description of Artificial Sequence: Synthetic peptide
  Seed: LLMWITQCFL (CTG1B_HUMAN)
LPMWITQCFV

SEQ ID NO: 32517 - protein, 9 aa, Artificial Sequence
  Description of Artificial Sequence: Synthetic peptide
  Seed: AARASGPGG (CTG1B_HUMAN)
ASRASGPGY

SEQ ID NO: 32518 - protein, 10 aa, Artificial Sequence
  Description of Artificial Sequence: Synthetic peptide
  Seed: YLAMPFATPM (CTG1B_HUMAN)
YVAMPFATPL

SEQ ID NO: 32519 - protein, 10 aa, Artificial Sequence
  Description of Artificial Sequence: Synthetic peptide
  Seed: LQQLSLLMWI (CTG1B_HUMAN)
LCQLSLLMWV

SEQ ID NO: 32520 - protein, 10 aa, Artificial Sequence
  Description of Artificial Sequence: Synthetic peptide
  Seed: RLTAADHRQL (CTG1B_HUMAN)
RCTAADHRQF

SEQ ID NO: 32521 - protein, 9 aa, Artificial Sequence
  Description of Artificial Sequence: Synthetic peptide
  Seed: APRGPHGGA (CTG1B_HUMAN)
APRGPHGGM

SEQ ID NO: 32522 - protein, 11 aa, Artificial Sequence
  Description of Artificial Sequence: Synthetic peptide
  Seed: FYLAMPFATPM (CTG1B_HUMAN)
FGLAMPFATPM

SEQ ID NO: 32523 - protein, 9 aa, Artificial Sequence
  Description of Artificial Sequence: Synthetic peptide
  Seed: LAMPFATPM (CTG1B_HUMAN)
LIMPFATPM

SEQ ID NO: 32524 - protein, 10 aa, Artificial Sequence
  Description of Artificial Sequence: Synthetic peptide
  Seed: NILTIRLTAA (CTG1B_HUMAN)
NMLTIRLTAV

SEQ ID NO: 32525 - protein, 10 aa, Artificial Sequence
  Description of Artificial Sequence: Synthetic peptide
  Seed: RGPESRLLEF (CTG1B_HUMAN)
RYPESRLLEM

SEQ ID NO: 32526 - protein, 9 aa, Artificial Sequence
  Description of Artificial Sequence: Synthetic peptide
  Seed: SISSCLQQL (CTG1B_HUMAN)
SQSSCLQQL

SEQ ID NO: 32527 - protein, 9 aa, Artificial Sequence
  Description of Artificial Sequence: Synthetic peptide
  Seed: VSGNILTIR (CTG1B_HUMAN)
VMGNILTIR

SEQ ID NO: 32528 - protein, 10 aa, Artificial Sequence
  Description of Artificial Sequence: Synthetic peptide
  Seed: TAADHRQLQL (CTG1B_HUMAN)
TRADHRQLQY

SEQ ID NO: 32529 - protein, 9 aa, Artificial Sequence
  Description of Artificial Sequence: Synthetic peptide
  Seed: MQAEGRGTG (CTG1B_HUMAN)
MNAEGRGTF

SEQ ID NO: 32530 - protein, 10 aa, Artificial Sequence
  Description of Artificial Sequence: Synthetic peptide
  Seed: FYLAMPFATP (CTG1B_HUMAN)
FPLAMPFATT

SEQ ID NO: 32531 - protein, 9 aa, Artificial Sequence
  Description of Artificial Sequence: Synthetic peptide
  Seed: MEAELARRS (CTG1B_HUMAN)
MEAELARRL

SEQ ID NO: 32532 - protein, 10 aa, Artificial Sequence
  Description of Artificial Sequence: Synthetic peptide
  Seed: FTVSGNILTI (CTG1B_HUMAN)
FVVSGNILTT

SEQ ID NO: 32533 - protein, 9 aa, Artificial Sequence
  Description of Artificial Sequence: Synthetic peptide
  Seed: LAMPFATPM (CTG1B_HUMAN)
LPMPFATPY

SEQ ID NO: 32534 - protein, 9 aa, Artificial Sequence
  Description of Artificial Sequence: Synthetic peptide
  Seed: RLLEFYLAM (CTG1B_HUMAN)
RYLEFYLAK

SEQ ID NO: 32535 - protein, 10 aa, Artificial Sequence
  Description of Artificial Sequence: Synthetic peptide
  Seed: GEAGATGGRG (CTG1B_HUMAN)
GEAGATGGRV

SEQ ID NO: 32536 - protein, 11 aa, Artificial Sequence
  Description of Artificial Sequence: Synthetic peptide
  Seed: ISSCLQQLSLL (CTG1B_HUMAN)
ITSCLQQLSLF

SEQ ID NO: 32537 - protein, 10 aa, Artificial Sequence
  Description of Artificial Sequence: Synthetic peptide
  Seed: RSLAQDAPPL (CTG1B_HUMAN)
RALAQDAPPV

SEQ ID NO: 32538 - protein, 9 aa, Artificial Sequence
  Description of Artificial Sequence: Synthetic peptide
  Seed: MPFATPMEA (CTG1B_HUMAN)
MMFATPMEW

SEQ ID NO: 32539 - protein, 9 aa, Artificial Sequence
  Description of Artificial Sequence: Synthetic peptide
  Seed: AQDAPPLPV (CTG1B_HUMAN)
AMDAPPLPV

SEQ ID NO: 32540 - protein, 9 aa, Artificial Sequence
  Description of Artificial Sequence: Synthetic peptide
  Seed: RQLQLSISS (CTG1B_HUMAN)
RKLQLSISI

SEQ ID NO: 32541 - protein, 10 aa, Artificial Sequence
  Description of Artificial Sequence: Synthetic peptide
  Seed: SRLLEFYLAM (CTG1B_HUMAN)
SFLLEFYLAI

SEQ ID NO: 32542 - protein, 9 aa, Artificial Sequence
  Description of Artificial Sequence: Synthetic peptide
  Seed: SLAQDAPPL (CTG1B_HUMAN)
SLAQDAPPI

SEQ ID NO: 32543 - protein, 9 aa, Artificial Sequence
  Description of Artificial Sequence: Synthetic peptide
  Seed: RRSLAQDAP (CTG1B_HUMAN)
RRSLAQDAL

SEQ ID NO: 32544 - protein, 10 aa, Artificial Sequence
  Description of Artificial Sequence: Synthetic peptide
  Seed: SRLLEFYLAM (CTG1B_HUMAN)
SSLLEFYLAI

SEQ ID NO: 32545 - protein, 9 aa, Artificial Sequence
  Description of Artificial Sequence: Synthetic peptide
  Seed: RLLEFYLAM (CTG1B_HUMAN)
RMLEFYLAT

SEQ ID NO: 32546 - protein, 9 aa, Artificial Sequence
  Description of Artificial Sequence: Synthetic peptide
  Seed: TAADHRQLQ (CTG1B_HUMAN)
TGADHRQLY

SEQ ID NO: 32547 - protein, 10 aa, Artificial Sequence
  Description of Artificial Sequence: Synthetic peptide
  Seed: FLPVFLAQPP (CTG1B_HUMAN)
FMPVFLAQPM

SEQ ID NO: 32548 - protein, 11 aa, Artificial Sequence
  Description of Artificial Sequence: Synthetic peptide
  Seed: MPFATPMEAEL (CTG1B_HUMAN)
MAFATPMEAEW

SEQ ID NO: 32549 - protein, 10 aa, Artificial Sequence
  Description of Artificial Sequence: Synthetic peptide
  Seed: YLAMPFATPM (CTG1B_HUMAN)
YGAMPFATPA

SEQ ID NO: 32550 - protein, 10 aa, Artificial Sequence
  Description of Artificial Sequence: Synthetic peptide
  Seed: LLEFYLAMPF (CTG1B_HUMAN)
LMEFYLAMPY

SEQ ID NO: 32551 - protein, 11 aa, Artificial Sequence
  Description of Artificial Sequence: Synthetic peptide
  Seed: RQLQLSISSCL (CTG1B_HUMAN)
RHLQLSISSCY

SEQ ID NO: 32552 - protein, 9 aa, Artificial Sequence
  Description of Artificial Sequence: Synthetic peptide
  Seed: AADHRQLQL (CTG1B_HUMAN)
ATDHRQLQW

SEQ ID NO: 32553 - protein, 10 aa, Artificial Sequence
  Description of Artificial Sequence: Synthetic peptide
  Seed: YLAMPFATPM (CTG1B_HUMAN)
YFAMPFATPF

SEQ ID NO: 32554 - protein, 10 aa, Artificial Sequence
  Description of Artificial Sequence: Synthetic peptide
  Seed: TAADHRQLQL (CTG1B_HUMAN)
TAADHRQLQW

SEQ ID NO: 32555 - protein, 10 aa, Artificial Sequence
  Description of Artificial Sequence: Synthetic peptide
  Seed: LEFYLAMPFA (CTG1B_HUMAN)
LAFYLAMPFY

SEQ ID NO: 32556 - protein, 10 aa, Artificial Sequence
  Description of Artificial Sequence: Synthetic peptide
  Seed: FTVSGNILTI (CTG1B_HUMAN)
FCVSGNILTV

SEQ ID NO: 32557 - protein, 9 aa, Artificial Sequence
  Description of Artificial Sequence: Synthetic peptide
  Seed: WITQCFLPV (CTG1B_HUMAN)
WQTQCFLPV

SEQ ID NO: 32558 - protein, 9 aa, Artificial Sequence
  Description of Artificial Sequence: Synthetic peptide
  Seed: YLAMPFATP (CTG1B_HUMAN)
YMAMPFATM

SEQ ID NO: 32559 - protein, 9 aa, Artificial Sequence
  Description of Artificial Sequence: Synthetic peptide
  Seed: AADHRQLQL (CTG1B_HUMAN)
AMDHRQLQL

SEQ ID NO: 32560 - protein, 9 aa, Artificial Sequence
  Description of Artificial Sequence: Synthetic peptide
  Seed: MPFATPMEA (CTG1B_HUMAN)
MGFATPMEW

SEQ ID NO: 32561 - protein, 9 aa, Artificial Sequence
  Description of Artificial Sequence: Synthetic peptide
  Seed: RLLEFYLAM (CTG1B_HUMAN)
RMLEFYLAM

SEQ ID NO: 32562 - protein, 9 aa, Artificial Sequence
  Description of Artificial Sequence: Synthetic peptide
  Seed: MPFATPMEA (CTG1B_HUMAN)
MIFATPMEM

SEQ ID NO: 32563 - protein, 11 aa, Artificial Sequence
  Description of Artificial Sequence: Synthetic peptide
  Seed: SCLQQLSLLMW (CTG1B_HUMAN)
SALQQLSLLMW

SEQ ID NO: 32564 - protein, 9 aa, Artificial Sequence
  Description of Artificial Sequence: Synthetic peptide
  Seed: GPHGGAASG (CTG1B_HUMAN)
GPHGGAASV

SEQ ID NO: 32565 - protein, 9 aa, Artificial Sequence
  Description of Artificial Sequence: Synthetic peptide
  Seed: AARASGPGG (CTG1B_HUMAN)
ASRASGPGR

SEQ ID NO: 32566 - protein, 11 aa, Artificial Sequence
  Description of Artificial Sequence: Synthetic peptide
  Seed: FYLAMPFATPM (CTG1B_HUMAN)
FPLAMPFATPV

SEQ ID NO: 32567 - protein, 10 aa, Artificial Sequence
  Description of Artificial Sequence: Synthetic peptide
  Seed: RGPHGGAASG (CTG1B_HUMAN)
RCPHGGAASF

SEQ ID NO: 32568 - protein, 9 aa, Artificial Sequence
  Description of Artificial Sequence: Synthetic peptide
  Seed: LMWITQCFL (CTG1B_HUMAN)
LTWITQCFV

SEQ ID NO: 32569 - protein, 11 aa, Artificial Sequence
  Description of Artificial Sequence: Synthetic peptide
  Seed: YLAMPFATPME (CTG1B_HUMAN)
YLAMPFATPMV

SEQ ID NO: 32570 - protein, 9 aa, Artificial Sequence
  Description of Artificial Sequence: Synthetic peptide
  Seed: GEAGATGGR (CTG1B_HUMAN)
GVAGATGGR

SEQ ID NO: 32571 - protein, 10 aa, Artificial Sequence
  Description of Artificial Sequence: Synthetic peptide
  Seed: FYLAMPFATP (CTG1B_HUMAN)
FWLAMPFATI

SEQ ID NO: 32572 - protein, 9 aa, Artificial Sequence
  Description of Artificial Sequence: Synthetic peptide
  Seed: AELARRSLA (CTG1B_HUMAN)
AELARRSLI

SEQ ID NO: 32573 - protein, 10 aa, Artificial Sequence
  Description of Artificial Sequence: Synthetic peptide
  Seed: LLMWITQCFL (CTG1B_HUMAN)
LMMWITQCFT

SEQ ID NO: 32574 - protein, 9 aa, Artificial Sequence
  Description of Artificial Sequence: Synthetic peptide
  Seed: SLLMWITQC (CTG1B_HUMAN)
SILMWITQL

SEQ ID NO: 32575 - protein, 10 aa, Artificial Sequence
  Description of Artificial Sequence: Synthetic peptide
  Seed: YLAMPFATPM (CTG1B_HUMAN)
YMAMPFATPR

SEQ ID NO: 32576 - protein, 9 aa, Artificial Sequence
  Description of Artificial Sequence: Synthetic peptide
  Seed: RQLQLSISS (CTG1B_HUMAN)
RNLQLSISY

SEQ ID NO: 32577 - protein, 10 aa, Artificial Sequence
  Description of Artificial Sequence: Synthetic peptide
  Seed: FTVSGNILTI (CTG1B_HUMAN)
FGVSGNILTL

SEQ ID NO: 32578 - protein, 10 aa, Artificial Sequence
  Description of Artificial Sequence: Synthetic peptide
  Seed: ISSCLQQLSL (CTG1B_HUMAN)
IPSCLQQLSW

SEQ ID NO: 32579 - protein, 9 aa, Artificial Sequence
  Description of Artificial Sequence: Synthetic peptide
  Seed: RLLEFYLAM (CTG1B_HUMAN)
RVLEFYLAM

SEQ ID NO: 32580 - protein, 10 aa, Artificial Sequence
  Description of Artificial Sequence: Synthetic peptide
  Seed: RGPHGGAASG (CTG1B_HUMAN)
RIPHGGAASF

SEQ ID NO: 32581 - protein, 9 aa, Artificial Sequence
  Description of Artificial Sequence: Synthetic peptide
  Seed: RQLQLSISS (CTG1B_HUMAN)
RELQLSISY

SEQ ID NO: 32582 - protein, 9 aa, Artificial Sequence
  Description of Artificial Sequence: Synthetic peptide
  Seed: IPDGPGGNA (CTG1B_HUMAN)
ILDGPGGNL

SEQ ID NO: 32583 - protein, 10 aa, Artificial Sequence
  Description of Artificial Sequence: Synthetic peptide
  Seed: YLAMPFATPM (CTG1B_HUMAN)
YCAMPFATPY

SEQ ID NO: 32584 - protein, 10 aa, Artificial Sequence
  Description of Artificial Sequence: Synthetic peptide
  Seed: MPFATPMEAE (CTG1B_HUMAN)
MPFATPMEAT

SEQ ID NO: 32585 - protein, 10 aa, Artificial Sequence
  Description of Artificial Sequence: Synthetic peptide
  Seed: EFTVSGNILT (CTG1B_HUMAN)
EKTVSGNILV

SEQ ID NO: 32586 - protein, 11 aa, Artificial Sequence
  Description of Artificial Sequence: Synthetic peptide
  Seed: LAMPFATPMEA (CTG1B_HUMAN)
LFMPFATPMEA

SEQ ID NO: 32587 - protein, 9 aa, Artificial Sequence
  Description of Artificial Sequence: Synthetic peptide
  Seed: MPFATPMEA (CTG1B_HUMAN)
MTFATPMEM

SEQ ID NO: 32588 - protein, 9 aa, Artificial Sequence
  Description of Artificial Sequence: Synthetic peptide
  Seed: RLLEFYLAM (CTG1B_HUMAN)
RVLEFYLAA

SEQ ID NO: 32589 - protein, 10 aa, Artificial Sequence
  Description of Artificial Sequence: Synthetic peptide
  Seed: LSISSCLQQL (CTG1B_HUMAN)
LQISSCLQQL

SEQ ID NO: 32590 - protein, 9 aa, Artificial Sequence
  Description of Artificial Sequence: Synthetic peptide
  Seed: LAMPFATPM (CTG1B_HUMAN)
LNMPFATPL

SEQ ID NO: 32591 - protein, 9 aa, Artificial Sequence
  Description of Artificial Sequence: Synthetic peptide
  Seed: LLMWITQCF (CTG1B_HUMAN)
LSMWITQCL

SEQ ID NO: 32592 - protein, 9 aa, Artificial Sequence
  Description of Artificial Sequence: Synthetic peptide
  Seed: LMWITQCFL (CTG1B_HUMAN)
LTWITQCFR

SEQ ID NO: 32593 - protein, 10 aa, Artificial Sequence
  Description of Artificial Sequence: Synthetic peptide
  Seed: TPMEAELARR (CTG1B_HUMAN)
TSMEAELARK

SEQ ID NO: 32594 - protein, 10 aa, Artificial Sequence
  Description of Artificial Sequence: Synthetic peptide
  Seed: AMPFATPMEA (CTG1B_HUMAN)
AMPFATPMEI

SEQ ID NO: 32595 - protein, 10 aa, Artificial Sequence
  Description of Artificial Sequence: Synthetic peptide
  Seed: SRLLEFYLAM (CTG1B_HUMAN)
SSLLEFYLAY

SEQ ID NO: 32596 - protein, 9 aa, Artificial Sequence
  Description of Artificial Sequence: Synthetic peptide
  Seed: LQLSISSCL (CTG1B_HUMAN)
LLLSISSCL

SEQ ID NO: 32597 - protein, 9 aa, Artificial Sequence
  Description of Artificial Sequence: Synthetic peptide
  Seed: LQLSISSCL (CTG1B_HUMAN)
LILSISSCI

SEQ ID NO: 32598 - protein, 9 aa, Artificial Sequence
  Description of Artificial Sequence: Synthetic peptide
  Seed: LAMPFATPM (CTG1B_HUMAN)
LLMPFATPW

SEQ ID NO: 32599 - protein, 9 aa, Artificial Sequence
  Description of Artificial Sequence: Synthetic peptide
  Seed: TQCFLPVFL (CTG1B_HUMAN)
TMCFLPVFY

SEQ ID NO: 32600 - protein, 9 aa, Artificial Sequence
  Description of Artificial Sequence: Synthetic peptide
  Seed: AARASGPGG (CTG1B_HUMAN)
AIRASGPGI

SEQ ID NO: 32601 - protein, 10 aa, Artificial Sequence
  Description of Artificial Sequence: Synthetic peptide
  Seed: RLLEFYLAMP (CTG1B_HUMAN)
RILEFYLAMA

SEQ ID NO: 32602 - protein, 11 aa, Artificial Sequence
  Description of Artificial Sequence: Synthetic peptide
  Seed: SLLMWITQCFL (CTG1B_HUMAN)
SLLMWITQCFV

SEQ ID NO: 32603 - protein, 11 aa, Artificial Sequence
  Description of Artificial Sequence: Synthetic peptide
  Seed: RASGPGGGAPR (CTG1B_HUMAN)
RPSGPGGGAPS

SEQ ID NO: 32604 - protein, 9 aa, Artificial Sequence
  Description of Artificial Sequence: Synthetic peptide
  Seed: IPDGPGGNA (CTG1B_HUMAN)
IADGPGGNI

SEQ ID NO: 32605 - protein, 11 aa, Artificial Sequence
  Description of Artificial Sequence: Synthetic peptide
  Seed: GDADGPGGPGI (CTG1B_HUMAN)
GEADGPGGPGI

SEQ ID NO: 32606 - protein, 11 aa, Artificial Sequence
  Description of Artificial Sequence: Synthetic peptide
  Seed: FYLAMPFATPM (CTG1B_HUMAN)
FFLAMPFATPF

SEQ ID NO: 32607 - protein, 9 aa, Artificial Sequence
  Description of Artificial Sequence: Synthetic peptide
  Seed: RLLEFYLAM (CTG1B_HUMAN)
RALEFYLAW

SEQ ID NO: 32608 - protein, 10 aa, Artificial Sequence
  Description of Artificial Sequence: Synthetic peptide
  Seed: RLLEFYLAMP (CTG1B_HUMAN)
RPLEFYLAMV

SEQ ID NO: 32609 - protein, 9 aa, Artificial Sequence
  Description of Artificial Sequence: Synthetic peptide
  Seed: ITQCFLPVF (CTG1B_HUMAN)
IQQCFLPVF

SEQ ID NO: 32610 - protein, 9 aa, Artificial Sequence
  Description of Artificial Sequence: Synthetic peptide
  Seed: ARGPESRLL (CTG1B_HUMAN)
AYGPESRLF

SEQ ID NO: 32611 - protein, 9 aa, Artificial Sequence
  Description of Artificial Sequence: Synthetic peptide
  Seed: LMWITQCFL (CTG1B_HUMAN)
LHWITQCFF

SEQ ID NO: 32612 - protein, 10 aa, Artificial Sequence
  Description of Artificial Sequence: Synthetic peptide
  Seed: SRLLEFYLAM (CTG1B_HUMAN)
SKLLEFYLAL

SEQ ID NO: 32613 - protein, 10 aa, Artificial Sequence
  Description of Artificial Sequence: Synthetic peptide
  Seed: LEFYLAMPFA (CTG1B_HUMAN)
LKFYLAMPFF

SEQ ID NO: 32614 - protein, 9 aa, Artificial Sequence
  Description of Artificial Sequence: Synthetic peptide
  Seed: SLAQDAPPL (CTG1B_HUMAN)
SQAQDAPPW

SEQ ID NO: 32615 - protein, 10 aa, Artificial Sequence
  Description of Artificial Sequence: Synthetic peptide
  Seed: YLAMPFATPM (CTG1B_HUMAN)
YIAMPFATPV

SEQ ID NO: 32616 - protein, 11 aa, Artificial Sequence
  Description of Artificial Sequence: Synthetic peptide
  Seed: RLLEFYLAMPF (CTG1B_HUMAN)
RSLEFYLAMPW

SEQ ID NO: 32617 - protein, 9 aa, Artificial Sequence
  Description of Artificial Sequence: Synthetic peptide
  Seed: LLMWITQCF (CTG1B_HUMAN)
LYMWITQCW

SEQ ID NO: 32618 - protein, 10 aa, Artificial Sequence
  Description of Artificial Sequence: Synthetic peptide
  Seed: SRLLEFYLAM (CTG1B_HUMAN)
SHLLEFYLAI

SEQ ID NO: 32619 - protein, 9 aa, Artificial Sequence
  Description of Artificial Sequence: Synthetic peptide
  Seed: LAMPFATPM (CTG1B_HUMAN)
LWMPFATPI

SEQ ID NO: 32620 - protein, 10 aa, Artificial Sequence
  Description of Artificial Sequence: Synthetic peptide
  Seed: SLLMWITQCF (CTG1B_HUMAN)
SCLMWITQCY

SEQ ID NO: 32621 - protein, 10 aa, Artificial Sequence
  Description of Artificial Sequence: Synthetic peptide
  Seed: GPRGAGAARA (CTG1B_HUMAN)
GPRGAGAARF

SEQ ID NO: 32622 - protein, 11 aa, Artificial Sequence
  Description of Artificial Sequence: Synthetic peptide
  Seed: RASGPGGGAPR (CTG1B_HUMAN)
RMSGPGGGAPW

SEQ ID NO: 32623 - protein, 9 aa, Artificial Sequence
  Description of Artificial Sequence: Synthetic peptide
  Seed: TVSGNILTI (CTG1B_HUMAN)
TVSGNILTR

SEQ ID NO: 32624 - protein, 8 aa, Artificial Sequence
  Description of Artificial Sequence: Synthetic peptide
  Seed: TAADHRQL (CTG1B_HUMAN)
TSADHRQL

SEQ ID NO: 32625 - protein, 9 aa, Artificial Sequence
  Description of Artificial Sequence: Synthetic peptide
  Seed: LEFYLAMPF (CTG1B_HUMAN)
LQFYLAMPW

SEQ ID NO: 32626 - protein, 10 aa, Artificial Sequence
  Description of Artificial Sequence: Synthetic peptide
  Seed: RLLEFYLAMP (CTG1B_HUMAN)
RMLEFYLAML

SEQ ID NO: 32627 - protein, 10 aa, Artificial Sequence
  Description of Artificial Sequence: Synthetic peptide
  Seed: SRLLEFYLAM (CTG1B_HUMAN)
SELLEFYLAI

SEQ ID NO: 32628 - protein, 11 aa, Artificial Sequence
  Description of Artificial Sequence: Synthetic peptide
  Seed: GPGEAGATGGR (CTG1B_HUMAN)
GAGEAGATGGY

SEQ ID NO: 32629 - protein, 9 aa, Artificial Sequence
  Description of Artificial Sequence: Synthetic peptide
  Seed: SLLMWITQC (CTG1B_HUMAN)
SLLMWITQL

SEQ ID NO: 32630 - protein, 9 aa, Artificial Sequence
  Description of Artificial Sequence: Synthetic peptide
  Seed: LAMPFATPM (CTG1B_HUMAN)
LQMPFATPR

SEQ ID NO: 32631 - protein, 10 aa, Artificial Sequence
  Description of Artificial Sequence: Synthetic peptide
  Seed: LLMWITQCFL (CTG1B_HUMAN)
LWMWITQCFV

SEQ ID NO: 32632 - protein, 9 aa, Artificial Sequence
  Description of Artificial Sequence: Synthetic peptide
  Seed: LAQPPSGQR (CTG1B_HUMAN)
LAQPPSGQY

SEQ ID NO: 32633 - protein, 11 aa, Artificial Sequence
  Description of Artificial Sequence: Synthetic peptide
  Seed: FYLAMPFATPM (CTG1B_HUMAN)
FTLAMPFATPA

SEQ ID NO: 32634 - protein, 9 aa, Artificial Sequence
  Description of Artificial Sequence: Synthetic peptide
  Seed: SGPGGGAPR (CTG1B_HUMAN)
SRPGGGAPY

SEQ ID NO: 32635 - protein, 9 aa, Artificial Sequence
  Description of Artificial Sequence: Synthetic peptide
  Seed: TVSGNILTI (CTG1B_HUMAN)
TMSGNILTA

SEQ ID NO: 32636 - protein, 11 aa, Artificial Sequence
  Description of Artificial Sequence: Synthetic peptide
  Seed: FYLAMPFATPM (CTG1B_HUMAN)
FYLAMPFATPV

SEQ ID NO: 32637 - protein, 10 aa, Artificial Sequence
  Description of Artificial Sequence: Synthetic peptide
  Seed: LLEFYLAMPF (CTG1B_HUMAN)
LAEFYLAMPF

SEQ ID NO: 32638 - protein, 9 aa, Artificial Sequence
  Description of Artificial Sequence: Synthetic peptide
  Seed: LEFYLAMPF (CTG1B_HUMAN)
LEFYLAMPL

SEQ ID NO: 32639 - protein, 9 aa, Artificial Sequence
  Description of Artificial Sequence: Synthetic peptide
  Seed: RLLEFYLAM (CTG1B_HUMAN)
RYLEFYLAI

SEQ ID NO: 32640 - protein, 11 aa, Artificial Sequence
  Description of Artificial Sequence: Synthetic peptide
  Seed: FYLAMPFATPM (CTG1B_HUMAN)
FFLAMPFATPY

SEQ ID NO: 32641 - protein, 10 aa, Artificial Sequence
  Description of Artificial Sequence: Synthetic peptide
  Seed: AQDAPPLPVP (CTG1B_HUMAN)
AEDAPPLPVA

SEQ ID NO: 32642 - protein, 9 aa, Artificial Sequence
  Description of Artificial Sequence: Synthetic peptide
  Seed: SISSCLQQL (CTG1B_HUMAN)
SVSSCLQQK

SEQ ID NO: 32643 - protein, 11 aa, Artificial Sequence
  Description of Artificial Sequence: Synthetic peptide
  Seed: RQLQLSISSCL (CTG1B_HUMAN)
RDLQLSISSCF

SEQ ID NO: 32644 - protein, 9 aa, Artificial Sequence
  Description of Artificial Sequence: Synthetic peptide
  Seed: FATPMEAEL (CTG1B_HUMAN)
FATPMEAEH

SEQ ID NO: 32645 - protein, 9 aa, Artificial Sequence
  Description of Artificial Sequence: Synthetic peptide
  Seed: LAMPFATPM (CTG1B_HUMAN)
LQMPFATPH

SEQ ID NO: 32646 - protein, 10 aa, Artificial Sequence
  Description of Artificial Sequence: Synthetic peptide
  Seed: RGPHGGAASG (CTG1B_HUMAN)
RQPHGGAASA

SEQ ID NO: 32647 - protein, 10 aa, Artificial Sequence
  Description of Artificial Sequence: Synthetic peptide
  Seed: RGPESRLLEF (CTG1B_HUMAN)
RWPESRLLEL

SEQ ID NO: 32648 - protein, 9 aa, Artificial Sequence
  Description of Artificial Sequence: Synthetic peptide
  Seed: SLAQDAPPL (CTG1B_HUMAN)
SVAQDAPPY

SEQ ID NO: 32649 - protein, 10 aa, Artificial Sequence
  Description of Artificial Sequence: Synthetic peptide
  Seed: RGPESRLLEF (CTG1B_HUMAN)
RSPESRLLEM

SEQ ID NO: 32650 - protein, 9 aa, Artificial Sequence
  Description of Artificial Sequence: Synthetic peptide
  Seed: KEFTVSGNI (CTG1B_HUMAN)
KQFTVSGNW

SEQ ID NO: 32651 - protein, 10 aa, Artificial Sequence
  Description of Artificial Sequence: Synthetic peptide
  Seed: LEFYLAMPFA (CTG1B_HUMAN)
LQFYLAMPFR

SEQ ID NO: 32652 - protein, 9 aa, Artificial Sequence
  Description of Artificial Sequence: Synthetic peptide
  Seed: SSCLQQLSL (CTG1B_HUMAN)
SACLQQLSF

SEQ ID NO: 32653 - protein, 9 aa, Artificial Sequence
  Description of Artificial Sequence: Synthetic peptide
  Seed: AADHRQLQL (CTG1B_HUMAN)
ASDHRQLQM

SEQ ID NO: 32654 - protein, 10 aa, Artificial Sequence
  Description of Artificial Sequence: Synthetic peptide
  Seed: GPRGAGAARA (CTG1B_HUMAN)
GPRGAGAARI

SEQ ID NO: 32655 - protein, 11 aa, Artificial Sequence
  Description of Artificial Sequence: Synthetic peptide
  Seed: RASGPGGGAPR (CTG1B_HUMAN)
RASGPGGGAPK

SEQ ID NO: 32656 - protein, 9 aa, Artificial Sequence
  Description of Artificial Sequence: Synthetic peptide
  Seed: AARASGPGG (CTG1B_HUMAN)
ASRASGPGL

SEQ ID NO: 32657 - protein, 11 aa, Artificial Sequence
  Description of Artificial Sequence: Synthetic peptide
  Seed: FYLAMPFATPM (CTG1B_HUMAN)
FWLAMPFATPW

SEQ ID NO: 32658 - protein, 9 aa, Artificial Sequence
  Description of Artificial Sequence: Synthetic peptide
  Seed: LLMWITQCF (CTG1B_HUMAN)
LFMWITQCF

SEQ ID NO: 32659 - protein, 10 aa, Artificial Sequence
  Description of Artificial Sequence: Synthetic peptide
  Seed: RSLAQDAPPL (CTG1B_HUMAN)
RFLAQDAPPI

SEQ ID NO: 32660 - protein, 9 aa, Artificial Sequence
  Description of Artificial Sequence: Synthetic peptide
  Seed: FTVSGNILT (CTG1B_HUMAN)
FTVSGNILV

SEQ ID NO: 32661 - protein, 11 aa, Artificial Sequence
  Description of Artificial Sequence: Synthetic peptide
  Seed: RLLEFYLAMPF (CTG1B_HUMAN)
RKLEFYLAMPI

SEQ ID NO: 32662 - protein, 10 aa, Artificial Sequence
  Description of Artificial Sequence: Synthetic peptide
  Seed: SRLLEFYLAM (CTG1B_HUMAN)
SPLLEFYLAV

SEQ ID NO: 32663 - protein, 9 aa, Artificial Sequence
  Description of Artificial Sequence: Synthetic peptide
  Seed: QQLSLLMWI (CTG1B_HUMAN)
QRLSLLMWL

SEQ ID NO: 32664 - protein, 10 aa, Artificial Sequence
  Description of Artificial Sequence: Synthetic peptide
  Seed: ADHRQLQLSI (CTG1B_HUMAN)
AEHRQLQLSM

SEQ ID NO: 32665 - protein, 9 aa, Artificial Sequence
  Description of Artificial Sequence: Synthetic peptide
  Seed: ASGPGGGAP (CTG1B_HUMAN)
AIGPGGGAF

SEQ ID NO: 32666 - protein, 10 aa, Artificial Sequence
  Description of Artificial Sequence: Synthetic peptide
  Seed: FYLAMPFATP (CTG1B_HUMAN)
FPLAMPFATA

SEQ ID NO: 32667 - protein, 10 aa, Artificial Sequence
  Description of Artificial Sequence: Synthetic peptide
  Seed: FTVSGNILTI (CTG1B_HUMAN)
FIVSGNILTL

SEQ ID NO: 32668 - protein, 10 aa, Artificial Sequence
  Description of Artificial Sequence: Synthetic peptide
  Seed: KEFTVSGNIL (CTG1B_HUMAN)
KEFTVSGNIA

SEQ ID NO: 32669 - protein, 11 aa, Artificial Sequence
  Description of Artificial Sequence: Synthetic peptide
  Seed: MPFATPMEAEL (CTG1B_HUMAN)
MPFATPMEAEV

SEQ ID NO: 32670 - protein, 9 aa, Artificial Sequence
  Description of Artificial Sequence: Synthetic peptide
  Seed: MPFATPMEA (CTG1B_HUMAN)
MPFATPMET

SEQ ID NO: 32671 - protein, 9 aa, Artificial Sequence
  Description of Artificial Sequence: Synthetic peptide
  Seed: LAMPFATPM (CTG1B_HUMAN)
LPMPFATPH

SEQ ID NO: 32672 - protein, 8 aa, Artificial Sequence
  Description of Artificial Sequence: Synthetic peptide
  Seed: HRQLQLSI (CTG1B_HUMAN)
HHQLQLSA

SEQ ID NO: 32673 - protein, 10 aa, Artificial Sequence
  Description of Artificial Sequence: Synthetic peptide
  Seed: SRLLEFYLAM (CTG1B_HUMAN)
SILLEFYLAV

SEQ ID NO: 32674 - protein, 9 aa, Artificial Sequence
  Description of Artificial Sequence: Synthetic peptide
  Seed: GPRGAGAAR (CTG1B_HUMAN)
GPRGAGAAI

SEQ ID NO: 32675 - protein, 9 aa, Artificial Sequence
  Description of Artificial Sequence: Synthetic peptide
  Seed: LMWITQCFL (CTG1B_HUMAN)
LLWITQCFL

SEQ ID NO: 32676 - protein, 10 aa, Artificial Sequence
  Description of Artificial Sequence: Synthetic peptide
  Seed: GAPRGPHGGA (CTG1B_HUMAN)
GSPRGPHGGM

SEQ ID NO: 32677 - protein, 10 aa, Artificial Sequence
  Description of Artificial Sequence: Synthetic peptide
  Seed: LEFYLAMPFA (CTG1B_HUMAN)
LHFYLAMPFY

SEQ ID NO: 32678 - protein, 11 aa, Artificial Sequence
  Description of Artificial Sequence: Synthetic peptide
  Seed: RLLEFYLAMPF (CTG1B_HUMAN)
RELEFYLAMPI

SEQ ID NO: 32679 - protein, 10 aa, Artificial Sequence
  Description of Artificial Sequence: Synthetic peptide
  Seed: YLAMPFATPM (CTG1B_HUMAN)
YWAMPFATPI

SEQ ID NO: 32680 - protein, 10 aa, Artificial Sequence
  Description of Artificial Sequence: Synthetic peptide
  Seed: RQLQLSISSC (CTG1B_HUMAN)
RQLQLSISSF

SEQ ID NO: 32681 - protein, 10 aa, Artificial Sequence
  Description of Artificial Sequence: Synthetic peptide
  Seed: RQLQLSISSC (CTG1B_HUMAN)
RQLQLSISSV

SEQ ID NO: 32682 - protein, 10 aa, Artificial Sequence
  Description of Artificial Sequence: Synthetic peptide
  Seed: FYLAMPFATP (CTG1B_HUMAN)
FALAMPFATI

SEQ ID NO: 32683 - protein, 10 aa, Artificial Sequence
  Description of Artificial Sequence: Synthetic peptide
  Seed: SRLLEFYLAM (CTG1B_HUMAN)
SFLLEFYLAA

SEQ ID NO: 32684 - protein, 10 aa, Artificial Sequence
  Description of Artificial Sequence: Synthetic peptide
  Seed: SRLLEFYLAM (CTG1B_HUMAN)
SDLLEFYLAI

SEQ ID NO: 32685 - protein, 9 aa, Artificial Sequence
  Description of Artificial Sequence: Synthetic peptide
  Seed: GARGPESRL (CTG1B_HUMAN)
GQRGPESRY

SEQ ID NO: 32686 - protein, 10 aa, Artificial Sequence
  Description of Artificial Sequence: Synthetic peptide
  Seed: FTVSGNILTI (CTG1B_HUMAN)
FHVSGNILTV

SEQ ID NO: 32687 - protein, 9 aa, Artificial Sequence
  Description of Artificial Sequence: Synthetic peptide
  Seed: AQPPSGQRR (CTG1B_HUMAN)
AAPPSGQRF

SEQ ID NO: 32688 - protein, 10 aa, Artificial Sequence
  Description of Artificial Sequence: Synthetic peptide
  Seed: LQQLSLLMWI (CTG1B_HUMAN)
LSQLSLLMWV

SEQ ID NO: 32689 - protein, 10 aa, Artificial Sequence
  Description of Artificial Sequence: Synthetic peptide
  Seed: SRLLEFYLAM (CTG1B_HUMAN)
SVLLEFYLAI

SEQ ID NO: 32690 - protein, 9 aa, Artificial Sequence
  Description of Artificial Sequence: Synthetic peptide
  Seed: AQPPSGQRR (CTG1B_HUMAN)
ATPPSGQRF

SEQ ID NO: 32691 - protein, 9 aa, Artificial Sequence
  Description of Artificial Sequence: Synthetic peptide
  Seed: MPFATPMEA (CTG1B_HUMAN)
MEFATPMEF

SEQ ID NO: 32692 - protein, 9 aa, Artificial Sequence
  Description of Artificial Sequence: Synthetic peptide
  Seed: SSCLQQLSL (CTG1B_HUMAN)
SICLQQLSY

SEQ ID NO: 32693 - protein, 9 aa, Artificial Sequence
  Description of Artificial Sequence: Synthetic peptide
  Seed: LAQPPSGQR (CTG1B_HUMAN)
LIQPPSGQY

SEQ ID NO: 32694 - protein, 10 aa, Artificial Sequence
  Description of Artificial Sequence: Synthetic peptide
  Seed: RGPHGGAASG (CTG1B_HUMAN)
RYPHGGAASV

SEQ ID NO: 32695 - protein, 10 aa, Artificial Sequence
  Description of Artificial Sequence: Synthetic peptide
  Seed: LAQPPSGQRR (CTG1B_HUMAN)
LTQPPSGQRR

SEQ ID NO: 32696 - protein, 10 aa, Artificial Sequence
  Description of Artificial Sequence: Synthetic peptide
  Seed: FYLAMPFATP (CTG1B_HUMAN)
FCLAMPFATM

SEQ ID NO: 32697 - protein, 9 aa, Artificial Sequence
  Description of Artificial Sequence: Synthetic peptide
  Seed: AARASGPGG (CTG1B_HUMAN)
AGRASGPGV

SEQ ID NO: 32698 - protein, 10 aa, Artificial Sequence
  Description of Artificial Sequence: Synthetic peptide
  Seed: GAPRGPHGGA (CTG1B_HUMAN)
GKPRGPHGGL

SEQ ID NO: 32699 - protein, 9 aa, Artificial Sequence
  Description of Artificial Sequence: Synthetic peptide
  Seed: LAMPFATPM (CTG1B_HUMAN)
LFMPFATPW

SEQ ID NO: 32700 - protein, 9 aa, Artificial Sequence
  Description of Artificial Sequence: Synthetic peptide
  Seed: LAMPFATPM (CTG1B_HUMAN)
LHMPFATPY

SEQ ID NO: 32701 - protein, 9 aa, Artificial Sequence
  Description of Artificial Sequence: Synthetic peptide
  Seed: MPFATPMEA (CTG1B_HUMAN)
MAFATPMEY

SEQ ID NO: 32702 - protein, 10 aa, Artificial Sequence
  Description of Artificial Sequence: Synthetic peptide
  Seed: GAPRGPHGGA (CTG1B_HUMAN)
GLPRGPHGGL

SEQ ID NO: 32703 - protein, 9 aa, Artificial Sequence
  Description of Artificial Sequence: Synthetic peptide
  Seed: MPFATPMEA (CTG1B_HUMAN)
MTFATPMEI

SEQ ID NO: 32704 - protein, 9 aa, Artificial Sequence
  Description of Artificial Sequence: Synthetic peptide
  Seed: RLLEFYLAM (CTG1B_HUMAN)
RELEFYLAI

SEQ ID NO: 32705 - protein, 9 aa, Artificial Sequence
  Description of Artificial Sequence: Synthetic peptide
  Seed: SLAQDAPPL (CTG1B_HUMAN)
SMAQDAPPY

SEQ ID NO: 32706 - protein, 10 aa, Artificial Sequence
  Description of Artificial Sequence: Synthetic peptide
  Seed: RASGPGGGAP (CTG1B_HUMAN)
RVSGPGGGAY

SEQ ID NO: 32707 - protein, 9 aa, Artificial Sequence
  Description of Artificial Sequence: Synthetic peptide
  Seed: MPFATPMEA (CTG1B_HUMAN)
MPFATPMEG

SEQ ID NO: 32708 - protein, 9 aa, Artificial Sequence
  Description of Artificial Sequence: Synthetic peptide
  Seed: TVSGNILTI (CTG1B_HUMAN)
TGSGNILTL

SEQ ID NO: 32709 - protein, 10 aa, Artificial Sequence
  Description of Artificial Sequence: Synthetic peptide
  Seed: SRLLEFYLAM (CTG1B_HUMAN)
SPLLEFYLAI

SEQ ID NO: 32710 - protein, 9 aa, Artificial Sequence
  Description of Artificial Sequence: Synthetic peptide
  Seed: AADHRQLQL (CTG1B_HUMAN)
ACDHRQLQL

SEQ ID NO: 32711 - protein, 10 aa, Artificial Sequence
  Description of Artificial Sequence: Synthetic peptide
  Seed: FYLAMPFATP (CTG1B_HUMAN)
FCLAMPFATV

SEQ ID NO: 32712 - protein, 9 aa, Artificial Sequence
  Description of Artificial Sequence: Synthetic peptide
  Seed: LPVFLAQPP (CTG1B_HUMAN)
LIVFLAQPY

SEQ ID NO: 32713 - protein, 11 aa, Artificial Sequence
  Description of Artificial Sequence: Synthetic peptide
  Seed: RLLEFYLAMPF (CTG1B_HUMAN)
RALEFYLAMPY

SEQ ID NO: 32714 - protein, 10 aa, Artificial Sequence
  Description of Artificial Sequence: Synthetic peptide
  Seed: FLPVFLAQPP (CTG1B_HUMAN)
FIPVFLAQPT

SEQ ID NO: 32715 - protein, 9 aa, Artificial Sequence
  Description of Artificial Sequence: Synthetic peptide
  Seed: LQLSISSCL (CTG1B_HUMAN)
LALSISSCY

SEQ ID NO: 32716 - protein, 11 aa, Artificial Sequence
  Description of Artificial Sequence: Synthetic peptide
  Seed: RLLEFYLAMPF (CTG1B_HUMAN)
RALEFYLAMPL

SEQ ID NO: 32717 - protein, 10 aa, Artificial Sequence
  Description of Artificial Sequence: Synthetic peptide
  Seed: YLAMPFATPM (CTG1B_HUMAN)
YQAMPFATPT

SEQ ID NO: 32718 - protein, 9 aa, Artificial Sequence
  Description of Artificial Sequence: Synthetic peptide
  Seed: AADHRQLQL (CTG1B_HUMAN)
ATDHRQLQM

SEQ ID NO: 32719 - protein, 10 aa, Artificial Sequence
  Description of Artificial Sequence: Synthetic peptide
  Seed: RGPHGGAASG (CTG1B_HUMAN)
RFPHGGAASM

SEQ ID NO: 32720 - protein, 9 aa, Artificial Sequence
  Description of Artificial Sequence: Synthetic peptide
  Seed: ESRLLEFYL (CTG1B_HUMAN)
ETRLLEFYV

SEQ ID NO: 32721 - protein, 9 aa, Artificial Sequence
  Description of Artificial Sequence: Synthetic peptide
  Seed: SLAQDAPPL (CTG1B_HUMAN)
SIAQDAPPV

SEQ ID NO: 32722 - protein, 10 aa, Artificial Sequence
  Description of Artificial Sequence: Synthetic peptide
  Seed: FYLAMPFATP (CTG1B_HUMAN)
FDLAMPFATL

SEQ ID NO: 32723 - protein, 9 aa, Artificial Sequence
  Description of Artificial Sequence: Synthetic peptide
  Seed: RLLEFYLAM (CTG1B_HUMAN)
RWLEFYLAY

SEQ ID NO: 32724 - protein, 11 aa, Artificial Sequence
  Description of Artificial Sequence: Synthetic peptide
  Seed: MWITQCFLPVF (CTG1B_HUMAN)
MTITQCFLPVW

SEQ ID NO: 32725 - protein, 9 aa, Artificial Sequence
  Description of Artificial Sequence: Synthetic peptide
  Seed: AARASGPGG (CTG1B_HUMAN)
AIRASGPGA

SEQ ID NO: 32726 - protein, 10 aa, Artificial Sequence
  Description of Artificial Sequence: Synthetic peptide
  Seed: FLPVFLAQPP (CTG1B_HUMAN)
FTPVFLAQPI

SEQ ID NO: 32727 - protein, 9 aa, Artificial Sequence
  Description of Artificial Sequence: Synthetic peptide
  Seed: ITQCFLPVF (CTG1B_HUMAN)
IWQCFLPVF

SEQ ID NO: 32728 - protein, 9 aa, Artificial Sequence
  Description of Artificial Sequence: Synthetic peptide
  Seed: SGPGGGAPR (CTG1B_HUMAN)
SGPGGGAPY

SEQ ID NO: 32729 - protein, 10 aa, Artificial Sequence
  Description of Artificial Sequence: Synthetic peptide
  Seed: FTVSGNILTI (CTG1B_HUMAN)
FIVSGNILTY

SEQ ID NO: 32730 - protein, 11 aa, Artificial Sequence
  Description of Artificial Sequence: Synthetic peptide
  Seed: LAMPFATPMEA (CTG1B_HUMAN)
LIMPFATPMEA

SEQ ID NO: 32731 - protein, 11 aa, Artificial Sequence
  Description of Artificial Sequence: Synthetic peptide
  Seed: RQLQLSISSCL (CTG1B_HUMAN)
RRLQLSISSCM

SEQ ID NO: 32732 - protein, 9 aa, Artificial Sequence
  Description of Artificial Sequence: Synthetic peptide
  Seed: AQDAPPLPV (CTG1B_HUMAN)
AIDAPPLPM

SEQ ID NO: 32733 - protein, 9 aa, Artificial Sequence
  Description of Artificial Sequence: Synthetic peptide
  Seed: ARGPESRLL (CTG1B_HUMAN)
ARGPESRLY

SEQ ID NO: 32734 - protein, 10 aa, Artificial Sequence
  Description of Artificial Sequence: Synthetic peptide
  Seed: FYLAMPFATP (CTG1B_HUMAN)
FNLAMPFATM

SEQ ID NO: 32735 - protein, 9 aa, Artificial Sequence
  Description of Artificial Sequence: Synthetic peptide
  Seed: GPRGAGAAR (CTG1B_HUMAN)
GPRGAGAAC

SEQ ID NO: 32736 - protein, 11 aa, Artificial Sequence
  Description of Artificial Sequence: Synthetic peptide
  Seed: RLLEFYLAMPF (CTG1B_HUMAN)
RNLEFYLAMPM

SEQ ID NO: 32737 - protein, 11 aa, Artificial Sequence
  Description of Artificial Sequence: Synthetic peptide
  Seed: IPDGPGGNAGG (CTG1B_HUMAN)
IPDGPGGNAGM

SEQ ID NO: 32738 - protein, 9 aa, Artificial Sequence
  Description of Artificial Sequence: Synthetic peptide
  Seed: LAMPFATPM (CTG1B_HUMAN)
LRMPFATPL

SEQ ID NO: 32739 - protein, 11 aa, Artificial Sequence
  Description of Artificial Sequence: Synthetic peptide
  Seed: KEFTVSGNILT (CTG1B_HUMAN)
KEFTVSGNILI

SEQ ID NO: 32740 - protein, 9 aa, Artificial Sequence
  Description of Artificial Sequence: Synthetic peptide
  Seed: RQLQLSISS (CTG1B_HUMAN)
RALQLSISV

SEQ ID NO: 32741 - protein, 9 aa, Artificial Sequence
  Description of Artificial Sequence: Synthetic peptide
  Seed: MPFATPMEA (CTG1B_HUMAN)
MQFATPMEM

SEQ ID NO: 32742 - protein, 10 aa, Artificial Sequence
  Description of Artificial Sequence: Synthetic peptide
  Seed: RGPHGGAASG (CTG1B_HUMAN)
RSPHGGAASV

SEQ ID NO: 32743 - protein, 11 aa, Artificial Sequence
  Description of Artificial Sequence: Synthetic peptide
  Seed: RLLEFYLAMPF (CTG1B_HUMAN)
RTLEFYLAMPM

SEQ ID NO: 32744 - protein, 11 aa, Artificial Sequence
  Description of Artificial Sequence: Synthetic peptide
  Seed: LAMPFATPMEA (CTG1B_HUMAN)
LHMPFATPMEA

SEQ ID NO: 32745 - protein, 11 aa, Artificial Sequence
  Description of Artificial Sequence: Synthetic peptide
  Seed: FYLAMPFATPM (CTG1B_HUMAN)
FCLAMPFATPV

SEQ ID NO: 32746 - protein, 10 aa, Artificial Sequence
  Description of Artificial Sequence: Synthetic peptide
  Seed: FYLAMPFATP (CTG1B_HUMAN)
FHLAMPFATV

SEQ ID NO: 32747 - protein, 9 aa, Artificial Sequence
  Description of Artificial Sequence: Synthetic peptide
  Seed: SLLMWITQC (CTG1B_HUMAN)
SSLMWITQV

SEQ ID NO: 32748 - protein, 10 aa, Artificial Sequence
  Description of Artificial Sequence: Synthetic peptide
  Seed: ASGPGGGAPR (CTG1B_HUMAN)
ARGPGGGAPF

SEQ ID NO: 32749 - protein, 9 aa, Artificial Sequence
  Description of Artificial Sequence: Synthetic peptide
  Seed: LAQPPSGQR (CTG1B_HUMAN)
LAQPPSGQM

SEQ ID NO: 32750 - protein, 10 aa, Artificial Sequence
  Description of Artificial Sequence: Synthetic peptide
  Seed: RGPESRLLEF (CTG1B_HUMAN)
RMPESRLLEF

SEQ ID NO: 32751 - protein, 9 aa, Artificial Sequence
  Description of Artificial Sequence: Synthetic peptide
  Seed: AARASGPGG (CTG1B_HUMAN)
ATRASGPGV

SEQ ID NO: 32752 - protein, 10 aa, Artificial Sequence
  Description of Artificial Sequence: Synthetic peptide
  Seed: ISSCLQQLSL (CTG1B_HUMAN)
IHSCLQQLSW

SEQ ID NO: 32753 - protein, 9 aa, Artificial Sequence
  Description of Artificial Sequence: Synthetic peptide
  Seed: ITQCFLPVF (CTG1B_HUMAN)
IWQCFLPVI

SEQ ID NO: 32754 - protein, 9 aa, Artificial Sequence
  Description of Artificial Sequence: Synthetic peptide
  Seed: SISSCLQQL (CTG1B_HUMAN)
SASSCLQQI

SEQ ID NO: 32755 - protein, 11 aa, Artificial Sequence
  Description of Artificial Sequence: Synthetic peptide
  Seed: APPLPVPGVLL (CTG1B_HUMAN)
APPLPVPGVLA

SEQ ID NO: 32756 - protein, 11 aa, Artificial Sequence
  Description of Artificial Sequence: Synthetic peptide
  Seed: SLLMWITQCFL (CTG1B_HUMAN)
SLLMWITQCFI

SEQ ID NO: 32757 - protein, 10 aa, Artificial Sequence
  Description of Artificial Sequence: Synthetic peptide
  Seed: FTVSGNILTI (CTG1B_HUMAN)
FTVSGNILTL

SEQ ID NO: 32758 - protein, 9 aa, Artificial Sequence
  Description of Artificial Sequence: Synthetic peptide
  Seed: LLKEFTVSG (CTG1B_HUMAN)
LIKEFTVSL

SEQ ID NO: 32759 - protein, 10 aa, Artificial Sequence
  Description of Artificial Sequence: Synthetic peptide
  Seed: SRLLEFYLAM (CTG1B_HUMAN)
SSLLEFYLAA

SEQ ID NO: 32760 - protein, 9 aa, Artificial Sequence
  Description of Artificial Sequence: Synthetic peptide
  Seed: SLAQDAPPL (CTG1B_HUMAN)
SIAQDAPPA

SEQ ID NO: 32761 - protein, 9 aa, Artificial Sequence
  Description of Artificial Sequence: Synthetic peptide
  Seed: TVSGNILTI (CTG1B_HUMAN)
TGSGNILTY

SEQ ID NO: 32762 - protein, 10 aa, Artificial Sequence
  Description of Artificial Sequence: Synthetic peptide
  Seed: FYLAMPFATP (CTG1B_HUMAN)
FKLAMPFATV

SEQ ID NO: 32763 - protein, 9 aa, Artificial Sequence
  Description of Artificial Sequence: Synthetic peptide
  Seed: MQAEGRGTG (CTG1B_HUMAN)
MKAEGRGTL

SEQ ID NO: 32764 - protein, 9 aa, Artificial Sequence
  Description of Artificial Sequence: Synthetic peptide
  Seed: LTAADHRQL (CTG1B_HUMAN)
LAAADHRQW

SEQ ID NO: 32765 - protein, 9 aa, Artificial Sequence
  Description of Artificial Sequence: Synthetic peptide
  Seed: AADHRQLQL (CTG1B_HUMAN)
AQDHRQLQY

SEQ ID NO: 32766 - protein, 9 aa, Artificial Sequence
  Description of Artificial Sequence: Synthetic peptide
  Seed: ASGPGGGAP (CTG1B_HUMAN)
ASGPGGGAL

SEQ ID NO: 32767 - protein, 10 aa, Artificial Sequence
  Description of Artificial Sequence: Synthetic peptide
  Seed: EFTVSGNILT (CTG1B_HUMAN)
EGTVSGNILI

SEQ ID NO: 32768 - protein, 11 aa, Artificial Sequence
  Description of Artificial Sequence: Synthetic peptide
  Seed: RASGPGGGAPR (CTG1B_HUMAN)
RASGPGGGAPW

SEQ ID NO: 32769 - protein, 11 aa, Artificial Sequence
  Description of Artificial Sequence: Synthetic peptide
  Seed: RASGPGGGAPR (CTG1B_HUMAN)
RISGPGGGAPK

SEQ ID NO: 32770 - protein, 9 aa, Artificial Sequence
  Description of Artificial Sequence: Synthetic peptide
  Seed: QQLSLLMWI (CTG1B_HUMAN)
QSLSLLMWV

SEQ ID NO: 32771 - protein, 11 aa, Artificial Sequence
  Description of Artificial Sequence: Synthetic peptide
  Seed: LLKEFTVSGNI (CTG1B_HUMAN)
LMKEFTVSGNV

SEQ ID NO: 32772 - protein, 9 aa, Artificial Sequence
  Description of Artificial Sequence: Synthetic peptide
  Seed: TPMEAELAR (CTG1B_HUMAN)
TPMEAELAY

SEQ ID NO: 32773 - protein, 10 aa, Artificial Sequence
  Description of Artificial Sequence: Synthetic peptide
  Seed: KEFTVSGNIL (CTG1B_HUMAN)
KAFTVSGNIF

SEQ ID NO: 32774 - protein, 11 aa, Artificial Sequence
  Description of Artificial Sequence: Synthetic peptide
  Seed: RLLEFYLAMPF (CTG1B_HUMAN)
RHLEFYLAMPV

SEQ ID NO: 32775 - protein, 11 aa, Artificial Sequence
  Description of Artificial Sequence: Synthetic peptide
  Seed: GAPRGPHGGAA (CTG1B_HUMAN)
GRPRGPHGGAI

SEQ ID NO: 32776 - protein, 10 aa, Artificial Sequence
  Description of Artificial Sequence: Synthetic peptide
  Seed: YLAMPFATPM (CTG1B_HUMAN)
YEAMPFATPV

SEQ ID NO: 32777 - protein, 10 aa, Artificial Sequence
  Description of Artificial Sequence: Synthetic peptide
  Seed: TAADHRQLQL (CTG1B_HUMAN)
TAADHRQLQF

SEQ ID NO: 32778 - protein, 10 aa, Artificial Sequence
  Description of Artificial Sequence: Synthetic peptide
  Seed: YLAMPFATPM (CTG1B_HUMAN)
YTAMPFATPT

SEQ ID NO: 32779 - protein, 9 aa, Artificial Sequence
  Description of Artificial Sequence: Synthetic peptide
  Seed: SLAQDAPPL (CTG1B_HUMAN)
SIAQDAPPF

SEQ ID NO: 32780 - protein, 9 aa, Artificial Sequence
  Description of Artificial Sequence: Synthetic peptide
  Seed: LAMPFATPM (CTG1B_HUMAN)
LKMPFATPH

SEQ ID NO: 32781 - protein, 10 aa, Artificial Sequence
  Description of Artificial Sequence: Synthetic peptide
  Seed: RLLEFYLAMP (CTG1B_HUMAN)
RVLEFYLAMV

SEQ ID NO: 32782 - protein, 10 aa, Artificial Sequence
  Description of Artificial Sequence: Synthetic peptide
  Seed: RGPHGGAASG (CTG1B_HUMAN)
RGPHGGAASL

SEQ ID NO: 32783 - protein, 10 aa, Artificial Sequence
  Description of Artificial Sequence: Synthetic peptide
  Seed: SRLLEFYLAM (CTG1B_HUMAN)
SKLLEFYLAY

SEQ ID NO: 32784 - protein, 9 aa, Artificial Sequence
  Description of Artificial Sequence: Synthetic peptide
  Seed: LLMWITQCF (CTG1B_HUMAN)
LAMWITQCY

SEQ ID NO: 32785 - protein, 9 aa, Artificial Sequence
  Description of Artificial Sequence: Synthetic peptide
  Seed: MPFATPMEA (CTG1B_HUMAN)
MTFATPMEV

SEQ ID NO: 32786 - protein, 10 aa, Artificial Sequence
  Description of Artificial Sequence: Synthetic peptide
  Seed: LLEFYLAMPF (CTG1B_HUMAN)
LFEFYLAMPL

SEQ ID NO: 32787 - protein, 9 aa, Artificial Sequence
  Description of Artificial Sequence: Synthetic peptide
  Seed: AQDAPPLPV (CTG1B_HUMAN)
AQDAPPLPM

SEQ ID NO: 32788 - protein, 11 aa, Artificial Sequence
  Description of Artificial Sequence: Synthetic peptide
  Seed: RLLEFYLAMPF (CTG1B_HUMAN)
RELEFYLAMPY

SEQ ID NO: 32789 - protein, 9 aa, Artificial Sequence
  Description of Artificial Sequence: Synthetic peptide
  Seed: ASGPGGGAP (CTG1B_HUMAN)
ATGPGGGAM

SEQ ID NO: 32790 - protein, 9 aa, Artificial Sequence
  Description of Artificial Sequence: Synthetic peptide
  Seed: SISSCLQQL (CTG1B_HUMAN)
SRSSCLQQM

SEQ ID NO: 32791 - protein, 9 aa, Artificial Sequence
  Description of Artificial Sequence: Synthetic peptide
  Seed: TQCFLPVFL (CTG1B_HUMAN)
TTCFLPVFV

SEQ ID NO: 32792 - protein, 9 aa, Artificial Sequence
  Description of Artificial Sequence: Synthetic peptide
  Seed: LLMWITQCF (CTG1B_HUMAN)
LEMWITQCF

SEQ ID NO: 32793 - protein, 11 aa, Artificial Sequence
  Description of Artificial Sequence: Synthetic peptide
  Seed: RASGPGGGAPR (CTG1B_HUMAN)
RTSGPGGGAPM

SEQ ID NO: 32794 - protein, 9 aa, Artificial Sequence
  Description of Artificial Sequence: Synthetic peptide
  Seed: TVSGNILTI (CTG1B_HUMAN)
TTSGNILTA

SEQ ID NO: 32795 - protein, 9 aa, Artificial Sequence
  Description of Artificial Sequence: Synthetic peptide
  Seed: RLLEFYLAM (CTG1B_HUMAN)
RCLEFYLAW

SEQ ID NO: 32796 - protein, 11 aa, Artificial Sequence
  Description of Artificial Sequence: Synthetic peptide
  Seed: FYLAMPFATPM (CTG1B_HUMAN)
FRLAMPFATPY

SEQ ID NO: 32797 - protein, 9 aa, Artificial Sequence
  Description of Artificial Sequence: Synthetic peptide
  Seed: LAMPFATPM (CTG1B_HUMAN)
LVMPFATPF

SEQ ID NO: 32798 - protein, 9 aa, Artificial Sequence
  Description of Artificial Sequence: Synthetic peptide
  Seed: SLLMWITQC (CTG1B_HUMAN)
STLMWITQA

SEQ ID NO: 32799 - protein, 11 aa, Artificial Sequence
  Description of Artificial Sequence: Synthetic peptide
  Seed: MPFATPMEAEL (CTG1B_HUMAN)
MSFATPMEAEY

SEQ ID NO: 32800 - protein, 11 aa, Artificial Sequence
  Description of Artificial Sequence: Synthetic peptide
  Seed: ISSCLQQLSLL (CTG1B_HUMAN)
ITSCLQQLSLY

SEQ ID NO: 32801 - protein, 11 aa, Artificial Sequence
  Description of Artificial Sequence: Synthetic peptide
  Seed: LTAADHRQLQL (CTG1B_HUMAN)
LAAADHRQLQW

SEQ ID NO: 32802 - protein, 11 aa, Artificial Sequence
  Description of Artificial Sequence: Synthetic peptide
  Seed: RLLEFYLAMPF (CTG1B_HUMAN)
RMLEFYLAMPM

SEQ ID NO: 32803 - protein, 9 aa, Artificial Sequence
  Description of Artificial Sequence: Synthetic peptide
  Seed: SISSCLQQL (CTG1B_HUMAN)
SLSSCLQQT

SEQ ID NO: 32804 - protein, 9 aa, Artificial Sequence
  Description of Artificial Sequence: Synthetic peptide
  Seed: TAADHRQLQ (CTG1B_HUMAN)
TVADHRQLL

SEQ ID NO: 32805 - protein, 9 aa, Artificial Sequence
  Description of Artificial Sequence: Synthetic peptide
  Seed: TVSGNILTI (CTG1B_HUMAN)
TVSGNILTA

SEQ ID NO: 32806 - protein, 9 aa, Artificial Sequence
  Description of Artificial Sequence: Synthetic peptide
  Seed: MPFATPMEA (CTG1B_HUMAN)
MDFATPMEF

SEQ ID NO: 32807 - protein, 10 aa, Artificial Sequence
  Description of Artificial Sequence: Synthetic peptide
  Seed: YLAMPFATPM (CTG1B_HUMAN)
YYAMPFATPY

SEQ ID NO: 32808 - protein, 9 aa, Artificial Sequence
  Description of Artificial Sequence: Synthetic peptide
  Seed: ITQCFLPVF (CTG1B_HUMAN)
IVQCFLPVW

SEQ ID NO: 32809 - protein, 10 aa, Artificial Sequence
  Description of Artificial Sequence: Synthetic peptide
  Seed: LSISSCLQQL (CTG1B_HUMAN)
LSISSCLQQF

SEQ ID NO: 32810 - protein, 9 aa, Artificial Sequence
  Description of Artificial Sequence: Synthetic peptide
  Seed: RLLEFYLAM (CTG1B_HUMAN)
RELEFYLAF

SEQ ID NO: 32811 - protein, 10 aa, Artificial Sequence
  Description of Artificial Sequence: Synthetic peptide
  Seed: FYLAMPFATP (CTG1B_HUMAN)
FVLAMPFATL

SEQ ID NO: 32812 - protein, 10 aa, Artificial Sequence
  Description of Artificial Sequence: Synthetic peptide
  Seed: FLPVFLAQPP (CTG1B_HUMAN)
FYPVFLAQPI

SEQ ID NO: 32813 - protein, 9 aa, Artificial Sequence
  Description of Artificial Sequence: Synthetic peptide
  Seed: AQDAPPLPV (CTG1B_HUMAN)
ALDAPPLPV

SEQ ID NO: 32814 - protein, 10 aa, Artificial Sequence
  Description of Artificial Sequence: Synthetic peptide
  Seed: FYLAMPFATP (CTG1B_HUMAN)
FTLAMPFATA

SEQ ID NO: 32815 - protein, 10 aa, Artificial Sequence
  Description of Artificial Sequence: Synthetic peptide
  Seed: FYLAMPFATP (CTG1B_HUMAN)
FTLAMPFATL

SEQ ID NO: 32816 - protein, 9 aa, Artificial Sequence
  Description of Artificial Sequence: Synthetic peptide
  Seed: ASGPGGGAP (CTG1B_HUMAN)
AGGPGGGAY

SEQ ID NO: 32817 - protein, 9 aa, Artificial Sequence
  Description of Artificial Sequence: Synthetic peptide
  Seed: RLLEFYLAM (CTG1B_HUMAN)
RQLEFYLAS

SEQ ID NO: 32818 - protein, 10 aa, Artificial Sequence
  Description of Artificial Sequence: Synthetic peptide
  Seed: RGPHGGAASG (CTG1B_HUMAN)
RQPHGGAASF

SEQ ID NO: 32819 - protein, 10 aa, Artificial Sequence
  Description of Artificial Sequence: Synthetic peptide
  Seed: SRLLEFYLAM (CTG1B_HUMAN)
SILLEFYLAM

SEQ ID NO: 32820 - protein, 9 aa, Artificial Sequence
  Description of Artificial Sequence: Synthetic peptide
  Seed: TVSGNILTI (CTG1B_HUMAN)
TSSGNILTI

SEQ ID NO: 32821 - protein, 10 aa, Artificial Sequence
  Description of Artificial Sequence: Synthetic peptide
  Seed: YLAMPFATPM (CTG1B_HUMAN)
YGAMPFATPL

SEQ ID NO: 32822 - protein, 10 aa, Artificial Sequence
  Description of Artificial Sequence: Synthetic peptide
  Seed: FLPVFLAQPP (CTG1B_HUMAN)
FGPVFLAQPI

SEQ ID NO: 32823 - protein, 9 aa, Artificial Sequence
  Description of Artificial Sequence: Synthetic peptide
  Seed: RLLEFYLAM (CTG1B_HUMAN)
RTLEFYLAL

SEQ ID NO: 32824 - protein, 9 aa, Artificial Sequence
  Description of Artificial Sequence: Synthetic peptide
  Seed: ITQCFLPVF (CTG1B_HUMAN)
ISQCFLPVL

SEQ ID NO: 32825 - protein, 9 aa, Artificial Sequence
  Description of Artificial Sequence: Synthetic peptide
  Seed: GARGPESRL (CTG1B_HUMAN)
GLRGPESRY

SEQ ID NO: 32826 - protein, 9 aa, Artificial Sequence
  Description of Artificial Sequence: Synthetic peptide
  Seed: VSGNILTIR (CTG1B_HUMAN)
VYGNILTIR

SEQ ID NO: 32827 - protein, 9 aa, Artificial Sequence
  Description of Artificial Sequence: Synthetic peptide
  Seed: LLMWITQCF (CTG1B_HUMAN)
LSMWITQCY

SEQ ID NO: 32828 - protein, 9 aa, Artificial Sequence
  Description of Artificial Sequence: Synthetic peptide
  Seed: RLLEFYLAM (CTG1B_HUMAN)
RYLEFYLAM

SEQ ID NO: 32829 - protein, 10 aa, Artificial Sequence
  Description of Artificial Sequence: Synthetic peptide
  Seed: AMPFATPMEA (CTG1B_HUMAN)
AFPFATPMEY

SEQ ID NO: 32830 - protein, 10 aa, Artificial Sequence
  Description of Artificial Sequence: Synthetic peptide
  Seed: MWITQCFLPV (CTG1B_HUMAN)
MIITQCFLPV

SEQ ID NO: 32831 - protein, 9 aa, Artificial Sequence
  Description of Artificial Sequence: Synthetic peptide
  Seed: SSCLQQLSL (CTG1B_HUMAN)
SGCLQQLSW

SEQ ID NO: 32832 - protein, 10 aa, Artificial Sequence
  Description of Artificial Sequence: Synthetic peptide
  Seed: FYLAMPFATP (CTG1B_HUMAN)
FWLAMPFATT

SEQ ID NO: 32833 - protein, 10 aa, Artificial Sequence
  Description of Artificial Sequence: Synthetic peptide
  Seed: RGPHGGAASG (CTG1B_HUMAN)
RRPHGGAASF

SEQ ID NO: 32834 - protein, 10 aa, Artificial Sequence
  Description of Artificial Sequence: Synthetic peptide
  Seed: SRLLEFYLAM (CTG1B_HUMAN)
STLLEFYLAY

SEQ ID NO: 32835 - protein, 10 aa, Artificial Sequence
  Description of Artificial Sequence: Synthetic peptide
  Seed: MPFATPMEAE (CTG1B_HUMAN)
MPFATPMEAK

SEQ ID NO: 32836 - protein, 9 aa, Artificial Sequence
  Description of Artificial Sequence: Synthetic peptide
  Seed: RQLQLSISS (CTG1B_HUMAN)
RVLQLSISI

SEQ ID NO: 32837 - protein, 10 aa, Artificial Sequence
  Description of Artificial Sequence: Synthetic peptide
  Seed: AEGRGTGGST (CTG1B_HUMAN)
AEGRGTGGSA

SEQ ID NO: 32838 - protein, 10 aa, Artificial Sequence
  Description of Artificial Sequence: Synthetic peptide
  Seed: LLEFYLAMPF (CTG1B_HUMAN)
LHEFYLAMPM

SEQ ID NO: 32839 - protein, 9 aa, Artificial Sequence
  Description of Artificial Sequence: Synthetic peptide
  Seed: MPFATPMEA (CTG1B_HUMAN)
MFFATPMEF

SEQ ID NO: 32840 - protein, 10 aa, Artificial Sequence
  Description of Artificial Sequence: Synthetic peptide
  Seed: SRLLEFYLAM (CTG1B_HUMAN)
SILLEFYLAI

SEQ ID NO: 32841 - protein, 10 aa, Artificial Sequence
  Description of Artificial Sequence: Synthetic peptide
  Seed: RGPHGGAASG (CTG1B_HUMAN)
RFPHGGAASL

SEQ ID NO: 32842 - protein, 10 aa, Artificial Sequence
  Description of Artificial Sequence: Synthetic peptide
  Seed: ISSCLQQLSL (CTG1B_HUMAN)
IESCLQQLSW

SEQ ID NO: 32843 - protein, 9 aa, Artificial Sequence
  Description of Artificial Sequence: Synthetic peptide
  Seed: YLAMPFATP (CTG1B_HUMAN)
YVAMPFATI

SEQ ID NO: 32844 - protein, 11 aa, Artificial Sequence
  Description of Artificial Sequence: Synthetic peptide
  Seed: KEFTVSGNILT (CTG1B_HUMAN)
KEFTVSGNILC

SEQ ID NO: 32845 - protein, 11 aa, Artificial Sequence
  Description of Artificial Sequence: Synthetic peptide
  Seed: RASGPGGGAPR (CTG1B_HUMAN)
RESGPGGGAPY

SEQ ID NO: 32846 - protein, 10 aa, Artificial Sequence
  Description of Artificial Sequence: Synthetic peptide
  Seed: KEFTVSGNIL (CTG1B_HUMAN)
KEFTVSGNIM

SEQ ID NO: 32847 - protein, 10 aa, Artificial Sequence
  Description of Artificial Sequence: Synthetic peptide
  Seed: AMPFATPMEA (CTG1B_HUMAN)
AYPFATPMEL

SEQ ID NO: 32848 - protein, 10 aa, Artificial Sequence
  Description of Artificial Sequence: Synthetic peptide
  Seed: LLMWITQCFL (CTG1B_HUMAN)
LMMWITQCFA

SEQ ID NO: 32849 - protein, 9 aa, Artificial Sequence
  Description of Artificial Sequence: Synthetic peptide
  Seed: SGPGGGAPR (CTG1B_HUMAN)
SIPGGGAPL

SEQ ID NO: 32850 - protein, 10 aa, Artificial Sequence
  Description of Artificial Sequence: Synthetic peptide
  Seed: TVSGNILTIR (CTG1B_HUMAN)
TASGNILTIF

SEQ ID NO: 32851 - protein, 9 aa, Artificial Sequence
  Description of Artificial Sequence: Synthetic peptide
  Seed: TVSGNILTI (CTG1B_HUMAN)
TNSGNILTV

SEQ ID NO: 32852 - protein, 9 aa, Artificial Sequence
  Description of Artificial Sequence: Synthetic peptide
  Seed: LAMPFATPM (CTG1B_HUMAN)
LSMPFATPW

SEQ ID NO: 32853 - protein, 11 aa, Artificial Sequence
  Description of Artificial Sequence: Synthetic peptide
  Seed: FYLAMPFATPM (CTG1B_HUMAN)
FCLAMPFATPF

SEQ ID NO: 32854 - protein, 10 aa, Artificial Sequence
  Description of Artificial Sequence: Synthetic peptide
  Seed: LAQDAPPLPV (CTG1B_HUMAN)
LAQDAPPLPF

SEQ ID NO: 32855 - protein, 10 aa, Artificial Sequence
  Description of Artificial Sequence: Synthetic peptide
  Seed: SLLMWITQCF (CTG1B_HUMAN)
SQLMWITQCF

SEQ ID NO: 32856 - protein, 10 aa, Artificial Sequence
  Description of Artificial Sequence: Synthetic peptide
  Seed: LLEFYLAMPF (CTG1B_HUMAN)
LHEFYLAMPY

SEQ ID NO: 32857 - protein, 9 aa, Artificial Sequence
  Description of Artificial Sequence: Synthetic peptide
  Seed: AQPPSGQRR (CTG1B_HUMAN)
AVPPSGQRL

SEQ ID NO: 32858 - protein, 9 aa, Artificial Sequence
  Description of Artificial Sequence: Synthetic peptide
  Seed: LPVPGVLLK (CTG1B_HUMAN)
LSVPGVLLM

SEQ ID NO: 32859 - protein, 10 aa, Artificial Sequence
  Description of Artificial Sequence: Synthetic peptide
  Seed: MPFATPMEAE (CTG1B_HUMAN)
MPFATPMEAH

SEQ ID NO: 32860 - protein, 10 aa, Artificial Sequence
  Description of Artificial Sequence: Synthetic peptide
  Seed: EFTVSGNILT (CTG1B_HUMAN)
EGTVSGNILV

SEQ ID NO: 32861 - protein, 9 aa, Artificial Sequence
  Description of Artificial Sequence: Synthetic peptide
  Seed: AADHRQLQL (CTG1B_HUMAN)
AFDHRQLQI

SEQ ID NO: 32862 - protein, 9 aa, Artificial Sequence
  Description of Artificial Sequence: Synthetic peptide
  Seed: MPFATPMEA (CTG1B_HUMAN)
MVFATPMEY

SEQ ID NO: 32863 - protein, 9 aa, Artificial Sequence
  Description of Artificial Sequence: Synthetic peptide
  Seed: ITQCFLPVF (CTG1B_HUMAN)
IYQCFLPVW

SEQ ID NO: 32864 - protein, 10 aa, Artificial Sequence
  Description of Artificial Sequence: Synthetic peptide
  Seed: FLPVFLAQPP (CTG1B_HUMAN)
FHPVFLAQPT

SEQ ID NO: 32865 - protein, 10 aa, Artificial Sequence
  Description of Artificial Sequence: Synthetic peptide
  Seed: GIPDGPGGNA (CTG1B_HUMAN)
GIPDGPGGNI

SEQ ID NO: 32866 - protein, 9 aa, Artificial Sequence
  Description of Artificial Sequence: Synthetic peptide
  Seed: RQLQLSISS (CTG1B_HUMAN)
RLLQLSISM

SEQ ID NO: 32867 - protein, 9 aa, Artificial Sequence
  Description of Artificial Sequence: Synthetic peptide
  Seed: LQLSISSCL (CTG1B_HUMAN)
LLLSISSCA

SEQ ID NO: 32868 - protein, 10 aa, Artificial Sequence
  Description of Artificial Sequence: Synthetic peptide
  Seed: LMWITQCFLP (CTG1B_HUMAN)
LLWITQCFLV

SEQ ID NO: 32869 - protein, 9 aa, Artificial Sequence
  Description of Artificial Sequence: Synthetic peptide
  Seed: SLAQDAPPL (CTG1B_HUMAN)
SAAQDAPPV

SEQ ID NO: 32870 - protein, 9 aa, Artificial Sequence
  Description of Artificial Sequence: Synthetic peptide
  Seed: SISSCLQQL (CTG1B_HUMAN)
SSSSCLQQR

SEQ ID NO: 32871 - protein, 10 aa, Artificial Sequence
  Description of Artificial Sequence: Synthetic peptide
  Seed: FYLAMPFATP (CTG1B_HUMAN)
FSLAMPFATM

SEQ ID NO: 32872 - protein, 9 aa, Artificial Sequence
  Description of Artificial Sequence: Synthetic peptide
  Seed: WITQCFLPV (CTG1B_HUMAN)
WITQCFLPL

SEQ ID NO: 32873 - protein, 10 aa, Artificial Sequence
  Description of Artificial Sequence: Synthetic peptide
  Seed: GIPDGPGGNA (CTG1B_HUMAN)
GAPDGPGGNV

SEQ ID NO: 32874 - protein, 10 aa, Artificial Sequence
  Description of Artificial Sequence: Synthetic peptide
  Seed: RGPHGGAASG (CTG1B_HUMAN)
RHPHGGAASV

SEQ ID NO: 32875 - protein, 9 aa, Artificial Sequence
  Description of Artificial Sequence: Synthetic peptide
  Seed: FATPMEAEL (CTG1B_HUMAN)
FWTPMEAEF

SEQ ID NO: 32876 - protein, 9 aa, Artificial Sequence
  Description of Artificial Sequence: Synthetic peptide
  Seed: AQDAPPLPV (CTG1B_HUMAN)
ASDAPPLPL

SEQ ID NO: 32877 - protein, 10 aa, Artificial Sequence
  Description of Artificial Sequence: Synthetic peptide
  Seed: FLPVFLAQPP (CTG1B_HUMAN)
FSPVFLAQPV

SEQ ID NO: 32878 - protein, 9 aa, Artificial Sequence
  Description of Artificial Sequence: Synthetic peptide
  Seed: LEFYLAMPF (CTG1B_HUMAN)
LLFYLAMPL

SEQ ID NO: 32879 - protein, 10 aa, Artificial Sequence
  Description of Artificial Sequence: Synthetic peptide
  Seed: WITQCFLPVF (CTG1B_HUMAN)
WTTQCFLPVW

SEQ ID NO: 32880 - protein, 9 aa, Artificial Sequence
  Description of Artificial Sequence: Synthetic peptide
  Seed: FLPVFLAQP (CTG1B_HUMAN)
FLPVFLAQI

SEQ ID NO: 32881 - protein, 10 aa, Artificial Sequence
  Description of Artificial Sequence: Synthetic peptide
  Seed: AASGLNGCCR (CTG1B_HUMAN)
ATSGLNGCCR

SEQ ID NO: 32882 - protein, 9 aa, Artificial Sequence
  Description of Artificial Sequence: Synthetic peptide
  Seed: SLAQDAPPL (CTG1B_HUMAN)
SQAQDAPPV

SEQ ID NO: 32883 - protein, 9 aa, Artificial Sequence
  Description of Artificial Sequence: Synthetic peptide
  Seed: RLLEFYLAM (CTG1B_HUMAN)
RGLEFYLAK

SEQ ID NO: 32884 - protein, 9 aa, Artificial Sequence
  Description of Artificial Sequence: Synthetic peptide
  Seed: MPFATPMEA (CTG1B_HUMAN)
MPFATPMEW

SEQ ID NO: 32885 - protein, 9 aa, Artificial Sequence
  Description of Artificial Sequence: Synthetic peptide
  Seed: LAMPFATPM (CTG1B_HUMAN)
LPMPFATPN

SEQ ID NO: 32886 - protein, 9 aa, Artificial Sequence
  Description of Artificial Sequence: Synthetic peptide
  Seed: SLAQDAPPL (CTG1B_HUMAN)
SIAQDAPPL

SEQ ID NO: 32887 - protein, 10 aa, Artificial Sequence
  Description of Artificial Sequence: Synthetic peptide
  Seed: WITQCFLPVF (CTG1B_HUMAN)
WQTQCFLPVF

SEQ ID NO: 32888 - protein, 9 aa, Artificial Sequence
  Description of Artificial Sequence: Synthetic peptide
  Seed: LAQPPSGQR (CTG1B_HUMAN)
LAQPPSGQF

SEQ ID NO: 32889 - protein, 9 aa, Artificial Sequence
  Description of Artificial Sequence: Synthetic peptide
  Seed: SCLQQLSLL (CTG1B_HUMAN)
STLQQLSLI

SEQ ID NO: 32890 - protein, 9 aa, Artificial Sequence
  Description of Artificial Sequence: Synthetic peptide
  Seed: LAMPFATPM (CTG1B_HUMAN)
LWMPFATPV

SEQ ID NO: 32891 - protein, 9 aa, Artificial Sequence
  Description of Artificial Sequence: Synthetic peptide
  Seed: SSCLQQLSL (CTG1B_HUMAN)
SMCLQQLSM

SEQ ID NO: 32892 - protein, 9 aa, Artificial Sequence
  Description of Artificial Sequence: Synthetic peptide
  Seed: QQLSLLMWI (CTG1B_HUMAN)
QVLSLLMWL

SEQ ID NO: 32893 - protein, 10 aa, Artificial Sequence
  Description of Artificial Sequence: Synthetic peptide
  Seed: FYLAMPFATP (CTG1B_HUMAN)
FCLAMPFATI

SEQ ID NO: 32894 - protein, 9 aa, Artificial Sequence
  Description of Artificial Sequence: Synthetic peptide
  Seed: QQLSLLMWI (CTG1B_HUMAN)
QQLSLLMWA

SEQ ID NO: 32895 - protein, 11 aa, Artificial Sequence
  Description of Artificial Sequence: Synthetic peptide
  Seed: GAPRGPHGGAA (CTG1B_HUMAN)
GKPRGPHGGAM

SEQ ID NO: 32896 - protein, 9 aa, Artificial Sequence
  Description of Artificial Sequence: Synthetic peptide
  Seed: TAADHRQLQ (CTG1B_HUMAN)
TAADHRQLL

SEQ ID NO: 32897 - protein, 9 aa, Artificial Sequence
  Description of Artificial Sequence: Synthetic peptide
  Seed: TVSGNILTI (CTG1B_HUMAN)
TFSGNILTL

SEQ ID NO: 32898 - protein, 9 aa, Artificial Sequence
  Description of Artificial Sequence: Synthetic peptide
  Seed: TVSGNILTI (CTG1B_HUMAN)
TYSGNILTF

SEQ ID NO: 32899 - protein, 10 aa, Artificial Sequence
  Description of Artificial Sequence: Synthetic peptide
  Seed: KEFTVSGNIL (CTG1B_HUMAN)
KMFTVSGNIF

SEQ ID NO: 32900 - protein, 9 aa, Artificial Sequence
  Description of Artificial Sequence: Synthetic peptide
  Seed: RLLEFYLAM (CTG1B_HUMAN)
RQLEFYLAT

SEQ ID NO: 32901 - protein, 11 aa, Artificial Sequence
  Description of Artificial Sequence: Synthetic peptide
  Seed: APRGPHGGAAS (CTG1B_HUMAN)
APRGPHGGAAA

SEQ ID NO: 32902 - protein, 9 aa, Artificial Sequence
  Description of Artificial Sequence: Synthetic peptide
  Seed: ITQCFLPVF (CTG1B_HUMAN)
IHQCFLPVY

SEQ ID NO: 32903 - protein, 11 aa, Artificial Sequence
  Description of Artificial Sequence: Synthetic peptide
  Seed: RLLEFYLAMPF (CTG1B_HUMAN)
RMLEFYLAMPL

SEQ ID NO: 32904 - protein, 10 aa, Artificial Sequence
  Description of Artificial Sequence: Synthetic peptide
  Seed: FTVSGNILTI (CTG1B_HUMAN)
FSVSGNILTW

SEQ ID NO: 32905 - protein, 10 aa, Artificial Sequence
  Description of Artificial Sequence: Synthetic peptide
  Seed: EFTVSGNILT (CTG1B_HUMAN)
EPTVSGNILI

SEQ ID NO: 32906 - protein, 9 aa, Artificial Sequence
  Description of Artificial Sequence: Synthetic peptide
  Seed: AADHRQLQL (CTG1B_HUMAN)
AEDHRQLQL

SEQ ID NO: 32907 - protein, 10 aa, Artificial Sequence
  Description of Artificial Sequence: Synthetic peptide
  Seed: TAADHRQLQL (CTG1B_HUMAN)
TMADHRQLQL

SEQ ID NO: 32908 - protein, 9 aa, Artificial Sequence
  Description of Artificial Sequence: Synthetic peptide
  Seed: AADHRQLQL (CTG1B_HUMAN)
ASDHRQLQY

SEQ ID NO: 32909 - protein, 9 aa, Artificial Sequence
  Description of Artificial Sequence: Synthetic peptide
  Seed: FTVSGNILT (CTG1B_HUMAN)
FLVSGNILV

SEQ ID NO: 32910 - protein, 10 aa, Artificial Sequence
  Description of Artificial Sequence: Synthetic peptide
  Seed: LLEFYLAMPF (CTG1B_HUMAN)
LTEFYLAMPW

SEQ ID NO: 32911 - protein, 11 aa, Artificial Sequence
  Description of Artificial Sequence: Synthetic peptide
  Seed: RLLEFYLAMPF (CTG1B_HUMAN)
RVLEFYLAMPL

SEQ ID NO: 32912 - protein, 9 aa, Artificial Sequence
  Description of Artificial Sequence: Synthetic peptide
  Seed: FTVSGNILT (CTG1B_HUMAN)
FSVSGNILV

SEQ ID NO: 32913 - protein, 10 aa, Artificial Sequence
  Description of Artificial Sequence: Synthetic peptide
  Seed: YLAMPFATPM (CTG1B_HUMAN)
YKAMPFATPV

SEQ ID NO: 32914 - protein, 10 aa, Artificial Sequence
  Description of Artificial Sequence: Synthetic peptide
  Seed: LLEFYLAMPF (CTG1B_HUMAN)
LDEFYLAMPW

SEQ ID NO: 32915 - protein, 9 aa, Artificial Sequence
  Description of Artificial Sequence: Synthetic peptide
  Seed: FLPVFLAQP (CTG1B_HUMAN)
FMPVFLAQV

SEQ ID NO: 32916 - protein, 11 aa, Artificial Sequence
  Description of Artificial Sequence: Synthetic peptide
  Seed: SLLMWITQCFL (CTG1B_HUMAN)
SMLMWITQCFV

SEQ ID NO: 32917 - protein, 10 aa, Artificial Sequence
  Description of Artificial Sequence: Synthetic peptide
  Seed: AQDAPPLPVP (CTG1B_HUMAN)
AEDAPPLPVT

SEQ ID NO: 32918 - protein, 9 aa, Artificial Sequence
  Description of Artificial Sequence: Synthetic peptide
  Seed: LLMWITQCF (CTG1B_HUMAN)
LEMWITQCY

SEQ ID NO: 32919 - protein, 9 aa, Artificial Sequence
  Description of Artificial Sequence: Synthetic peptide
  Seed: LLMWITQCF (CTG1B_HUMAN)
LYMWITQCV

SEQ ID NO: 32920 - protein, 9 aa, Artificial Sequence
  Description of Artificial Sequence: Synthetic peptide
  Seed: MPFATPMEA (CTG1B_HUMAN)
MIFATPMEW

SEQ ID NO: 32921 - protein, 9 aa, Artificial Sequence
  Description of Artificial Sequence: Synthetic peptide
  Seed: AQDAPPLPV (CTG1B_HUMAN)
AYDAPPLPI

SEQ ID NO: 32922 - protein, 11 aa, Artificial Sequence
  Description of Artificial Sequence: Synthetic peptide
  Seed: AARASGPGGGA (CTG1B_HUMAN)
AVRASGPGGGY

SEQ ID NO: 32923 - protein, 9 aa, Artificial Sequence
  Description of Artificial Sequence: Synthetic peptide
  Seed: TVSGNILTI (CTG1B_HUMAN)
TMSGNILTK

SEQ ID NO: 32924 - protein, 10 aa, Artificial Sequence
  Description of Artificial Sequence: Synthetic peptide
  Seed: SRLLEFYLAM (CTG1B_HUMAN)
SVLLEFYLAY

SEQ ID NO: 32925 - protein, 10 aa, Artificial Sequence
  Description of Artificial Sequence: Synthetic peptide
  Seed: LLMWITQCFL (CTG1B_HUMAN)
LTMWITQCFK

SEQ ID NO: 32926 - protein, 9 aa, Artificial Sequence
  Description of Artificial Sequence: Synthetic peptide
  Seed: RLLEFYLAM (CTG1B_HUMAN)
RWLEFYLAM

SEQ ID NO: 32927 - protein, 10 aa, Artificial Sequence
  Description of Artificial Sequence: Synthetic peptide
  Seed: MPFATPMEAE (CTG1B_HUMAN)
MPFATPMEAV

SEQ ID NO: 32928 - protein, 10 aa, Artificial Sequence
  Description of Artificial Sequence: Synthetic peptide
  Seed: RLTAADHRQL (CTG1B_HUMAN)
RNTAADHRQF

SEQ ID NO: 32929 - protein, 9 aa, Artificial Sequence
  Description of Artificial Sequence: Synthetic peptide
  Seed: SISSCLQQL (CTG1B_HUMAN)
SVSSCLQQL

SEQ ID NO: 32930 - protein, 9 aa, Artificial Sequence
  Description of Artificial Sequence: Synthetic peptide
  Seed: TAADHRQLQ (CTG1B_HUMAN)
TTADHRQLM

SEQ ID NO: 32931 - protein, 11 aa, Artificial Sequence
  Description of Artificial Sequence: Synthetic peptide
  Seed: EAGATGGRGPR (CTG1B_HUMAN)
EVGATGGRGPK

SEQ ID NO: 32932 - protein, 10 aa, Artificial Sequence
  Description of Artificial Sequence: Synthetic peptide
  Seed: LLEFYLAMPF (CTG1B_HUMAN)
LNEFYLAMPY

SEQ ID NO: 32933 - protein, 11 aa, Artificial Sequence
  Description of Artificial Sequence: Synthetic peptide
  Seed: LLEFYLAMPFA (CTG1B_HUMAN)
LLEFYLAMPFV

SEQ ID NO: 32934 - protein, 10 aa, Artificial Sequence
  Description of Artificial Sequence: Synthetic peptide
  Seed: RGPHGGAASG (CTG1B_HUMAN)
RTPHGGAASV

SEQ ID NO: 32935 - protein, 9 aa, Artificial Sequence
  Description of Artificial Sequence: Synthetic peptide
  Seed: LAMPFATPM (CTG1B_HUMAN)
LMMPFATPR

SEQ ID NO: 32936 - protein, 9 aa, Artificial Sequence
  Description of Artificial Sequence: Synthetic peptide
  Seed: MPFATPMEA (CTG1B_HUMAN)
MCFATPMEM

SEQ ID NO: 32937 - protein, 9 aa, Artificial Sequence
  Description of Artificial Sequence: Synthetic peptide
  Seed: AQDAPPLPV (CTG1B_HUMAN)
ACDAPPLPF

SEQ ID NO: 32938 - protein, 9 aa, Artificial Sequence
  Description of Artificial Sequence: Synthetic peptide
  Seed: LAMPFATPM (CTG1B_HUMAN)
LPMPFATPP

SEQ ID NO: 32939 - protein, 10 aa, Artificial Sequence
  Description of Artificial Sequence: Synthetic peptide
  Seed: RSLAQDAPPL (CTG1B_HUMAN)
RSLAQDAPPK

SEQ ID NO: 32940 - protein, 9 aa, Artificial Sequence
  Description of Artificial Sequence: Synthetic peptide
  Seed: LMWITQCFL (CTG1B_HUMAN)
LMWITQCFV

SEQ ID NO: 32941 - protein, 10 aa, Artificial Sequence
  Description of Artificial Sequence: Synthetic peptide
  Seed: MPFATPMEAE (CTG1B_HUMAN)
MPFATPMEAY

SEQ ID NO: 32942 - protein, 9 aa, Artificial Sequence
  Description of Artificial Sequence: Synthetic peptide
  Seed: FATPMEAEL (CTG1B_HUMAN)
FWTPMEAEY

SEQ ID NO: 32943 - protein, 9 aa, Artificial Sequence
  Description of Artificial Sequence: Synthetic peptide
  Seed: TVSGNILTI (CTG1B_HUMAN)
TQSGNILTF

SEQ ID NO: 32944 - protein, 9 aa, Artificial Sequence
  Description of Artificial Sequence: Synthetic peptide
  Seed: FLPVFLAQP (CTG1B_HUMAN)
FIPVFLAQA

SEQ ID NO: 32945 - protein, 10 aa, Artificial Sequence
  Description of Artificial Sequence: Synthetic peptide
  Seed: RLLEFYLAMP (CTG1B_HUMAN)
RQLEFYLAML

SEQ ID NO: 32946 - protein, 10 aa, Artificial Sequence
  Description of Artificial Sequence: Synthetic peptide
  Seed: FTVSGNILTI (CTG1B_HUMAN)
FTVSGNILTA

SEQ ID NO: 32947 - protein, 10 aa, Artificial Sequence
  Description of Artificial Sequence: Synthetic peptide
  Seed: FTVSGNILTI (CTG1B_HUMAN)
FVVSGNILTI

SEQ ID NO: 32948 - protein, 9 aa, Artificial Sequence
  Description of Artificial Sequence: Synthetic peptide
  Seed: RLLEFYLAM (CTG1B_HUMAN)
RFLEFYLAL

SEQ ID NO: 32949 - protein, 11 aa, Artificial Sequence
  Description of Artificial Sequence: Synthetic peptide
  Seed: RLLEFYLAMPF (CTG1B_HUMAN)
RLLEFYLAMPY

SEQ ID NO: 32950 - protein, 10 aa, Artificial Sequence
  Description of Artificial Sequence: Synthetic peptide
  Seed: TVSGNILTIR (CTG1B_HUMAN)
TMSGNILTIK

SEQ ID NO: 32951 - protein, 10 aa, Artificial Sequence
  Description of Artificial Sequence: Synthetic peptide
  Seed: RGPHGGAASG (CTG1B_HUMAN)
RAPHGGAASF

SEQ ID NO: 32952 - protein, 9 aa, Artificial Sequence
  Description of Artificial Sequence: Synthetic peptide
  Seed: SISSCLQQL (CTG1B_HUMAN)
SLSSCLQQY

SEQ ID NO: 32953 - protein, 10 aa, Artificial Sequence
  Description of Artificial Sequence: Synthetic peptide
  Seed: APRGPHGGAA (CTG1B_HUMAN)
APRGPHGGAV

SEQ ID NO: 32954 - protein, 9 aa, Artificial Sequence
  Description of Artificial Sequence: Synthetic peptide
  Seed: LAMPFATPM (CTG1B_HUMAN)
LAMPFATPR

SEQ ID NO: 32955 - protein, 9 aa, Artificial Sequence
  Description of Artificial Sequence: Synthetic peptide
  Seed: AQDAPPLPV (CTG1B_HUMAN)
ATDAPPLPM

SEQ ID NO: 32956 - protein, 10 aa, Artificial Sequence
  Description of Artificial Sequence: Synthetic peptide
  Seed: FLPVFLAQPP (CTG1B_HUMAN)
FLPVFLAQPI

SEQ ID NO: 32957 - protein, 9 aa, Artificial Sequence
  Description of Artificial Sequence: Synthetic peptide
  Seed: LAQPPSGQR (CTG1B_HUMAN)
LVQPPSGQL

SEQ ID NO: 32958 - protein, 11 aa, Artificial Sequence
  Description of Artificial Sequence: Synthetic peptide
  Seed: YLAMPFATPME (CTG1B_HUMAN)
YLAMPFATPMI

SEQ ID NO: 32959 - protein, 10 aa, Artificial Sequence
  Description of Artificial Sequence: Synthetic peptide
  Seed: YLAMPFATPM (CTG1B_HUMAN)
YDAMPFATPF

SEQ ID NO: 32960 - protein, 9 aa, Artificial Sequence
  Description of Artificial Sequence: Synthetic peptide
  Seed: LAMPFATPM (CTG1B_HUMAN)
LGMPFATPL

SEQ ID NO: 32961 - protein, 9 aa, Artificial Sequence
  Description of Artificial Sequence: Synthetic peptide
  Seed: LPVPGVLLK (CTG1B_HUMAN)
LPVPGVLLT

SEQ ID NO: 32962 - protein, 11 aa, Artificial Sequence
  Description of Artificial Sequence: Synthetic peptide
  Seed: LLMWITQCFLP (CTG1B_HUMAN)
LMMWITQCFLA

SEQ ID NO: 32963 - protein, 9 aa, Artificial Sequence
  Description of Artificial Sequence: Synthetic peptide
  Seed: RQLQLSISS (CTG1B_HUMAN)
RKLQLSISL

SEQ ID NO: 32964 - protein, 11 aa, Artificial Sequence
  Description of Artificial Sequence: Synthetic peptide
  Seed: GAPRGPHGGAA (CTG1B_HUMAN)
GKPRGPHGGAL

SEQ ID NO: 32965 - protein, 10 aa, Artificial Sequence
  Description of Artificial Sequence: Synthetic peptide
  Seed: YLAMPFATPM (CTG1B_HUMAN)
YPAMPFATPI

SEQ ID NO: 32966 - protein, 11 aa, Artificial Sequence
  Description of Artificial Sequence: Synthetic peptide
  Seed: ARASGPGGGAP (CTG1B_HUMAN)
ARASGPGGGAM

SEQ ID NO: 32967 - protein, 11 aa, Artificial Sequence
  Description of Artificial Sequence: Synthetic peptide
  Seed: RQLQLSISSCL (CTG1B_HUMAN)
RALQLSISSCF

SEQ ID NO: 32968 - protein, 9 aa, Artificial Sequence
  Description of Artificial Sequence: Synthetic peptide
  Seed: TVSGNILTI (CTG1B_HUMAN)
TASGNILTW

SEQ ID NO: 32969 - protein, 9 aa, Artificial Sequence
  Description of Artificial Sequence: Synthetic peptide
  Seed: AADHRQLQL (CTG1B_HUMAN)
APDHRQLQL

SEQ ID NO: 32970 - protein, 9 aa, Artificial Sequence
  Description of Artificial Sequence: Synthetic peptide
  Seed: APPLPVPGV (CTG1B_HUMAN)
AVPLPVPGM

SEQ ID NO: 32971 - protein, 10 aa, Artificial Sequence
  Description of Artificial Sequence: Synthetic peptide
  Seed: TVSGNILTIR (CTG1B_HUMAN)
TYSGNILTIR

SEQ ID NO: 32972 - protein, 11 aa, Artificial Sequence
  Description of Artificial Sequence: Synthetic peptide
  Seed: RASGPGGGAPR (CTG1B_HUMAN)
RPSGPGGGAPA

SEQ ID NO: 32973 - protein, 11 aa, Artificial Sequence
  Description of Artificial Sequence: Synthetic peptide
  Seed: FYLAMPFATPM (CTG1B_HUMAN)
FQLAMPFATPV

SEQ ID NO: 32974 - protein, 9 aa, Artificial Sequence
  Description of Artificial Sequence: Synthetic peptide
  Seed: FATPMEAEL (CTG1B_HUMAN)
FQTPMEAEF

SEQ ID NO: 32975 - protein, 10 aa, Artificial Sequence
  Description of Artificial Sequence: Synthetic peptide
  Seed: RGPESRLLEF (CTG1B_HUMAN)
RHPESRLLEL

SEQ ID NO: 32976 - protein, 10 aa, Artificial Sequence
  Description of Artificial Sequence: Synthetic peptide
  Seed: TAADHRQLQL (CTG1B_HUMAN)
TMADHRQLQW

SEQ ID NO: 32977 - protein, 9 aa, Artificial Sequence
  Description of Artificial Sequence: Synthetic peptide
  Seed: SLAQDAPPL (CTG1B_HUMAN)
SMAQDAPPF

SEQ ID NO: 32978 - protein, 10 aa, Artificial Sequence
  Description of Artificial Sequence: Synthetic peptide
  Seed: LQQLSLLMWI (CTG1B_HUMAN)
LEQLSLLMWV

SEQ ID NO: 32979 - protein, 9 aa, Artificial Sequence
  Description of Artificial Sequence: Synthetic peptide
  Seed: FLPVFLAQP (CTG1B_HUMAN)
FTPVFLAQV

SEQ ID NO: 32980 - protein, 11 aa, Artificial Sequence
  Description of Artificial Sequence: Synthetic peptide
  Seed: FYLAMPFATPM (CTG1B_HUMAN)
FGLAMPFATPL

SEQ ID NO: 32981 - protein, 11 aa, Artificial Sequence
  Description of Artificial Sequence: Synthetic peptide
  Seed: FYLAMPFATPM (CTG1B_HUMAN)
FILAMPFATPA

SEQ ID NO: 32982 - protein, 10 aa, Artificial Sequence
  Description of Artificial Sequence: Synthetic peptide
  Seed: LLEFYLAMPF (CTG1B_HUMAN)
LIEFYLAMPL

SEQ ID NO: 32983 - protein, 9 aa, Artificial Sequence
  Description of Artificial Sequence: Synthetic peptide
  Seed: LEFYLAMPF (CTG1B_HUMAN)
LKFYLAMPM

SEQ ID NO: 32984 - protein, 10 aa, Artificial Sequence
  Description of Artificial Sequence: Synthetic peptide
  Seed: FYLAMPFATP (CTG1B_HUMAN)
FALAMPFATT

SEQ ID NO: 32985 - protein, 11 aa, Artificial Sequence
  Description of Artificial Sequence: Synthetic peptide
  Seed: FYLAMPFATPM (CTG1B_HUMAN)
FILAMPFATPI

SEQ ID NO: 32986 - protein, 9 aa, Artificial Sequence
  Description of Artificial Sequence: Synthetic peptide
  Seed: LAMPFATPM (CTG1B_HUMAN)
LKMPFATPM

SEQ ID NO: 32987 - protein, 10 aa, Artificial Sequence
  Description of Artificial Sequence: Synthetic peptide
  Seed: SRLLEFYLAM (CTG1B_HUMAN)
SQLLEFYLAV

SEQ ID NO: 32988 - protein, 10 aa, Artificial Sequence
  Description of Artificial Sequence: Synthetic peptide
  Seed: AGATGGRGPR (CTG1B_HUMAN)
AAATGGRGPY

SEQ ID NO: 32989 - protein, 9 aa, Artificial Sequence
  Description of Artificial Sequence: Synthetic peptide
  Seed: LAMPFATPM (CTG1B_HUMAN)
LLMPFATPV

SEQ ID NO: 32990 - protein, 10 aa, Artificial Sequence
  Description of Artificial Sequence: Synthetic peptide
  Seed: EFTVSGNILT (CTG1B_HUMAN)
EFTVSGNILV

SEQ ID NO: 32991 - protein, 11 aa, Artificial Sequence
  Description of Artificial Sequence: Synthetic peptide
  Seed: SLLMWITQCFL (CTG1B_HUMAN)
SCLMWITQCFV

SEQ ID NO: 32992 - protein, 9 aa, Artificial Sequence
  Description of Artificial Sequence: Synthetic peptide
  Seed: LAMPFATPM (CTG1B_HUMAN)
LGMPFATPV

SEQ ID NO: 32993 - protein, 10 aa, Artificial Sequence
  Description of Artificial Sequence: Synthetic peptide
  Seed: FLAQPPSGQR (CTG1B_HUMAN)
FTAQPPSGQK

SEQ ID NO: 32994 - protein, 11 aa, Artificial Sequence
  Description of Artificial Sequence: Synthetic peptide
  Seed: NAGGPGEAGAT (CTG1B_HUMAN)
NAGGPGEAGAF

SEQ ID NO: 32995 - protein, 9 aa, Artificial Sequence
  Description of Artificial Sequence: Synthetic peptide
  Seed: CGARGPESR (CTG1B_HUMAN)
CAARGPESL

SEQ ID NO: 32996 - protein, 10 aa, Artificial Sequence
  Description of Artificial Sequence: Synthetic peptide
  Seed: FYLAMPFATP (CTG1B_HUMAN)
FILAMPFATV

SEQ ID NO: 32997 - protein, 9 aa, Artificial Sequence
  Description of Artificial Sequence: Synthetic peptide
  Seed: ITQCFLPVF (CTG1B_HUMAN)
IEQCFLPVY

SEQ ID NO: 32998 - protein, 10 aa, Artificial Sequence
  Description of Artificial Sequence: Synthetic peptide
  Seed: SRLLEFYLAM (CTG1B_HUMAN)
SMLLEFYLAM

SEQ ID NO: 32999 - protein, 9 aa, Artificial Sequence
  Description of Artificial Sequence: Synthetic peptide
  Seed: TQCFLPVFL (CTG1B_HUMAN)
TMCFLPVFF

SEQ ID NO: 33000 - protein, 9 aa, Artificial Sequence
  Description of Artificial Sequence: Synthetic peptide
  Seed: LEFYLAMPF (CTG1B_HUMAN)
LKFYLAMPH

SEQ ID NO: 33001 - protein, 11 aa, Artificial Sequence
  Description of Artificial Sequence: Synthetic peptide
  Seed: YLAMPFATPME (CTG1B_HUMAN)
YAAMPFATPMY

SEQ ID NO: 33002 - protein, 10 aa, Artificial Sequence
  Description of Artificial Sequence: Synthetic peptide
  Seed: MWITQCFLPV (CTG1B_HUMAN)
MMITQCFLPA

SEQ ID NO: 33003 - protein, 10 aa, Artificial Sequence
  Description of Artificial Sequence: Synthetic peptide
  Seed: AMPFATPMEA (CTG1B_HUMAN)
AYPFATPMEF

SEQ ID NO: 33004 - protein, 10 aa, Artificial Sequence
  Description of Artificial Sequence: Synthetic peptide
  Seed: MEAELARRSL (CTG1B_HUMAN)
MPAELARRSM

SEQ ID NO: 33005 - protein, 11 aa, Artificial Sequence
  Description of Artificial Sequence: Synthetic peptide
  Seed: YLAMPFATPME (CTG1B_HUMAN)
YTAMPFATPMV

SEQ ID NO: 33006 - protein, 9 aa, Artificial Sequence
  Description of Artificial Sequence: Synthetic peptide
  Seed: LEFYLAMPF (CTG1B_HUMAN)
LTFYLAMPY

SEQ ID NO: 33007 - protein, 10 aa, Artificial Sequence
  Description of Artificial Sequence: Synthetic peptide
  Seed: FYLAMPFATP (CTG1B_HUMAN)
FWLAMPFATL

SEQ ID NO: 33008 - protein, 11 aa, Artificial Sequence
  Description of Artificial Sequence: Synthetic peptide
  Seed: RLLEFYLAMPF (CTG1B_HUMAN)
RGLEFYLAMPV

SEQ ID NO: 33009 - protein, 10 aa, Artificial Sequence
  Description of Artificial Sequence: Synthetic peptide
  Seed: TAADHRQLQL (CTG1B_HUMAN)
TPADHRQLQL

SEQ ID NO: 33010 - protein, 10 aa, Artificial Sequence
  Description of Artificial Sequence: Synthetic peptide
  Seed: SRLLEFYLAM (CTG1B_HUMAN)
SYLLEFYLAM

SEQ ID NO: 33011 - protein, 11 aa, Artificial Sequence
  Description of Artificial Sequence: Synthetic peptide
  Seed: RQLQLSISSCL (CTG1B_HUMAN)
RLLQLSISSCF

SEQ ID NO: 33012 - protein, 9 aa, Artificial Sequence
  Description of Artificial Sequence: Synthetic peptide
  Seed: LAMPFATPM (CTG1B_HUMAN)
LMMPFATPY

SEQ ID NO: 33013 - protein, 11 aa, Artificial Sequence
  Description of Artificial Sequence: Synthetic peptide
  Seed: GAPRGPHGGAA (CTG1B_HUMAN)
GFPRGPHGGAM

SEQ ID NO: 33014 - protein, 9 aa, Artificial Sequence
  Description of Artificial Sequence: Synthetic peptide
  Seed: AQDAPPLPV (CTG1B_HUMAN)
ACDAPPLPL

SEQ ID NO: 33015 - protein, 9 aa, Artificial Sequence
  Description of Artificial Sequence: Synthetic peptide
  Seed: RLLEFYLAM (CTG1B_HUMAN)
RDLEFYLAY

SEQ ID NO: 33016 - protein, 9 aa, Artificial Sequence
  Description of Artificial Sequence: Synthetic peptide
  Seed: MPFATPMEA (CTG1B_HUMAN)
MYFATPMEY

SEQ ID NO: 33017 - protein, 11 aa, Artificial Sequence
  Description of Artificial Sequence: Synthetic peptide
  Seed: RLLEFYLAMPF (CTG1B_HUMAN)
RCLEFYLAMPF

SEQ ID NO: 33018 - protein, 9 aa, Artificial Sequence
  Description of Artificial Sequence: Synthetic peptide
  Seed: ASGPGGGAP (CTG1B_HUMAN)
ATGPGGGAF

SEQ ID NO: 33019 - protein, 10 aa, Artificial Sequence
  Description of Artificial Sequence: Synthetic peptide
  Seed: FYLAMPFATP (CTG1B_HUMAN)
FILAMPFATA

SEQ ID NO: 33020 - protein, 9 aa, Artificial Sequence
  Description of Artificial Sequence: Synthetic peptide
  Seed: RLLEFYLAM (CTG1B_HUMAN)
RILEFYLAV

SEQ ID NO: 33021 - protein, 9 aa, Artificial Sequence
  Description of Artificial Sequence: Synthetic peptide
  Seed: AQDAPPLPV (CTG1B_HUMAN)
AMDAPPLPL

SEQ ID NO: 33022 - protein, 9 aa, Artificial Sequence
  Description of Artificial Sequence: Synthetic peptide
  Seed: AADHRQLQL (CTG1B_HUMAN)
AIDHRQLQF

SEQ ID NO: 33023 - protein, 10 aa, Artificial Sequence
  Description of Artificial Sequence: Synthetic peptide
  Seed: AMPFATPMEA (CTG1B_HUMAN)
AWPFATPMEY

SEQ ID NO: 33024 - protein, 9 aa, Artificial Sequence
  Description of Artificial Sequence: Synthetic peptide
  Seed: RLLEFYLAM (CTG1B_HUMAN)
RILEFYLAL

SEQ ID NO: 33025 - protein, 11 aa, Artificial Sequence
  Description of Artificial Sequence: Synthetic peptide
  Seed: ISSCLQQLSLL (CTG1B_HUMAN)
ISSCLQQLSLW

SEQ ID NO: 33026 - protein, 9 aa, Artificial Sequence
  Description of Artificial Sequence: Synthetic peptide
  Seed: SSCLQQLSL (CTG1B_HUMAN)
SQCLQQLSI

SEQ ID NO: 33027 - protein, 9 aa, Artificial Sequence
  Description of Artificial Sequence: Synthetic peptide
  Seed: FATPMEAEL (CTG1B_HUMAN)
FVTPMEAEF

SEQ ID NO: 33028 - protein, 9 aa, Artificial Sequence
  Description of Artificial Sequence: Synthetic peptide
  Seed: LQLSISSCL (CTG1B_HUMAN)
LQLSISSCF

SEQ ID NO: 33029 - protein, 11 aa, Artificial Sequence
  Description of Artificial Sequence: Synthetic peptide
  Seed: SCLQQLSLLMW (CTG1B_HUMAN)
SSLQQLSLLMW

SEQ ID NO: 33030 - protein, 10 aa, Artificial Sequence
  Description of Artificial Sequence: Synthetic peptide
  Seed: LLEFYLAMPF (CTG1B_HUMAN)
LEEFYLAMPF

SEQ ID NO: 33031 - protein, 11 aa, Artificial Sequence
  Description of Artificial Sequence: Synthetic peptide
  Seed: LLMWITQCFLP (CTG1B_HUMAN)
LLMWITQCFLA

SEQ ID NO: 33032 - protein, 9 aa, Artificial Sequence
  Description of Artificial Sequence: Synthetic peptide
  Seed: MQAEGRGTG (CTG1B_HUMAN)
MMAEGRGTI

SEQ ID NO: 33033 - protein, 11 aa, Artificial Sequence
  Description of Artificial Sequence: Synthetic peptide
  Seed: SLLMWITQCFL (CTG1B_HUMAN)
SNLMWITQCFV

SEQ ID NO: 33034 - protein, 10 aa, Artificial Sequence
  Description of Artificial Sequence: Synthetic peptide
  Seed: SRLLEFYLAM (CTG1B_HUMAN)
SVLLEFYLAL

SEQ ID NO: 33035 - protein, 10 aa, Artificial Sequence
  Description of Artificial Sequence: Synthetic peptide
  Seed: YLAMPFATPM (CTG1B_HUMAN)
YKAMPFATPL

SEQ ID NO: 33036 - protein, 10 aa, Artificial Sequence
  Description of Artificial Sequence: Synthetic peptide
  Seed: ASGPGGGAPR (CTG1B_HUMAN)
AMGPGGGAPR

SEQ ID NO: 33037 - protein, 11 aa, Artificial Sequence
  Description of Artificial Sequence: Synthetic peptide
  Seed: FYLAMPFATPM (CTG1B_HUMAN)
FKLAMPFATPF

SEQ ID NO: 33038 - protein, 9 aa, Artificial Sequence
  Description of Artificial Sequence: Synthetic peptide
  Seed: IPDGPGGNA (CTG1B_HUMAN)
ITDGPGGNL

SEQ ID NO: 33039 - protein, 9 aa, Artificial Sequence
  Description of Artificial Sequence: Synthetic peptide
  Seed: AQDAPPLPV (CTG1B_HUMAN)
AHDAPPLPF

SEQ ID NO: 33040 - protein, 9 aa, Artificial Sequence
  Description of Artificial Sequence: Synthetic peptide
  Seed: SCLQQLSLL (CTG1B_HUMAN)
SSLQQLSLL

SEQ ID NO: 33041 - protein, 9 aa, Artificial Sequence
  Description of Artificial Sequence: Synthetic peptide
  Seed: LQLSISSCL (CTG1B_HUMAN)
LILSISSCF

SEQ ID NO: 33042 - protein, 9 aa, Artificial Sequence
  Description of Artificial Sequence: Synthetic peptide
  Seed: LAMPFATPM (CTG1B_HUMAN)
LIMPFATPL

SEQ ID NO: 33043 - protein, 9 aa, Artificial Sequence
  Description of Artificial Sequence: Synthetic peptide
  Seed: FYLAMPFAT (CTG1B_HUMAN)
FYLAMPFAY

SEQ ID NO: 33044 - protein, 11 aa, Artificial Sequence
  Description of Artificial Sequence: Synthetic peptide
  Seed: RASGPGGGAPR (CTG1B_HUMAN)
RRSGPGGGAPY

SEQ ID NO: 33045 - protein, 9 aa, Artificial Sequence
  Description of Artificial Sequence: Synthetic peptide
  Seed: LAMPFATPM (CTG1B_HUMAN)
LPMPFATPI

SEQ ID NO: 33046 - protein, 9 aa, Artificial Sequence
  Description of Artificial Sequence: Synthetic peptide
  Seed: GVLLKEFTV (CTG1B_HUMAN)
GLLLKEFTV

SEQ ID NO: 33047 - protein, 11 aa, Artificial Sequence
  Description of Artificial Sequence: Synthetic peptide
  Seed: RLLEFYLAMPF (CTG1B_HUMAN)
RMLEFYLAMPA

SEQ ID NO: 33048 - protein, 11 aa, Artificial Sequence
  Description of Artificial Sequence: Synthetic peptide
  Seed: SLLMWITQCFL (CTG1B_HUMAN)
SPLMWITQCFV

SEQ ID NO: 33049 - protein, 10 aa, Artificial Sequence
  Description of Artificial Sequence: Synthetic peptide
  Seed: GIPDGPGGNA (CTG1B_HUMAN)
GVPDGPGGNY

SEQ ID NO: 33050 - protein, 10 aa, Artificial Sequence
  Description of Artificial Sequence: Synthetic peptide
  Seed: FLPVFLAQPP (CTG1B_HUMAN)
FLPVFLAQPL

SEQ ID NO: 33051 - protein, 9 aa, Artificial Sequence
  Description of Artificial Sequence: Synthetic peptide
  Seed: TVSGNILTI (CTG1B_HUMAN)
TFSGNILTY

SEQ ID NO: 33052 - protein, 10 aa, Artificial Sequence
  Description of Artificial Sequence: Synthetic peptide
  Seed: RLLEFYLAMP (CTG1B_HUMAN)
RMLEFYLAMM

SEQ ID NO: 33053 - protein, 9 aa, Artificial Sequence
  Description of Artificial Sequence: Synthetic peptide
  Seed: FYLAMPFAT (CTG1B_HUMAN)
FWLAMPFAM

SEQ ID NO: 33054 - protein, 9 aa, Artificial Sequence
  Description of Artificial Sequence: Synthetic peptide
  Seed: LAMPFATPM (CTG1B_HUMAN)
LRMPFATPY

SEQ ID NO: 33055 - protein, 11 aa, Artificial Sequence
  Description of Artificial Sequence: Synthetic peptide
  Seed: YLAMPFATPME (CTG1B_HUMAN)
YDAMPFATPMV

SEQ ID NO: 33056 - protein, 9 aa, Artificial Sequence
  Description of Artificial Sequence: Synthetic peptide
  Seed: RQLQLSISS (CTG1B_HUMAN)
RRLQLSISF

SEQ ID NO: 33057 - protein, 10 aa, Artificial Sequence
  Description of Artificial Sequence: Synthetic peptide
  Seed: FTVSGNILTI (CTG1B_HUMAN)
FTVSGNILTF

SEQ ID NO: 33058 - protein, 10 aa, Artificial Sequence
  Description of Artificial Sequence: Synthetic peptide
  Seed: YLAMPFATPM (CTG1B_HUMAN)
YLAMPFATPY

SEQ ID NO: 33059 - protein, 9 aa, Artificial Sequence
  Description of Artificial Sequence: Synthetic peptide
  Seed: RLLEFYLAM (CTG1B_HUMAN)
RNLEFYLAR

SEQ ID NO: 33060 - protein, 9 aa, Artificial Sequence
  Description of Artificial Sequence: Synthetic peptide
  Seed: TVSGNILTI (CTG1B_HUMAN)
TPSGNILTM

SEQ ID NO: 33061 - protein, 10 aa, Artificial Sequence
  Description of Artificial Sequence: Synthetic peptide
  Seed: RGPESRLLEF (CTG1B_HUMAN)
RQPESRLLEF

SEQ ID NO: 33062 - protein, 9 aa, Artificial Sequence
  Description of Artificial Sequence: Synthetic peptide
  Seed: LPVPGVLLK (CTG1B_HUMAN)
LGVPGVLLM

SEQ ID NO: 33063 - protein, 9 aa, Artificial Sequence
  Description of Artificial Sequence: Synthetic peptide
  Seed: SSCLQQLSL (CTG1B_HUMAN)
STCLQQLSY

SEQ ID NO: 33064 - protein, 9 aa, Artificial Sequence
  Description of Artificial Sequence: Synthetic peptide
  Seed: LAMPFATPM (CTG1B_HUMAN)
LMMPFATPH

SEQ ID NO: 33065 - protein, 11 aa, Artificial Sequence
  Description of Artificial Sequence: Synthetic peptide
  Seed: FYLAMPFATPM (CTG1B_HUMAN)
FVLAMPFATPA

SEQ ID NO: 33066 - protein, 10 aa, Artificial Sequence
  Description of Artificial Sequence: Synthetic peptide
  Seed: LSISSCLQQL (CTG1B_HUMAN)
LVISSCLQQV

SEQ ID NO: 33067 - protein, 10 aa, Artificial Sequence
  Description of Artificial Sequence: Synthetic peptide
  Seed: LLEFYLAMPF (CTG1B_HUMAN)
LAEFYLAMPW

SEQ ID NO: 33068 - protein, 10 aa, Artificial Sequence
  Description of Artificial Sequence: Synthetic peptide
  Seed: RGPESRLLEF (CTG1B_HUMAN)
RTPESRLLEW

SEQ ID NO: 33069 - protein, 11 aa, Artificial Sequence
  Description of Artificial Sequence: Synthetic peptide
  Seed: MWITQCFLPVF (CTG1B_HUMAN)
MYITQCFLPVI

SEQ ID NO: 33070 - protein, 10 aa, Artificial Sequence
  Description of Artificial Sequence: Synthetic peptide
  Seed: RLTAADHRQL (CTG1B_HUMAN)
RATAADHRQF

SEQ ID NO: 33071 - protein, 9 aa, Artificial Sequence
  Description of Artificial Sequence: Synthetic peptide
  Seed: SGPGGGAPR (CTG1B_HUMAN)
SMPGGGAPR

SEQ ID NO: 33072 - protein, 10 aa, Artificial Sequence
  Description of Artificial Sequence: Synthetic peptide
  Seed: RGPHGGAASG (CTG1B_HUMAN)
RQPHGGAASM

SEQ ID NO: 33073 - protein, 9 aa, Artificial Sequence
  Description of Artificial Sequence: Synthetic peptide
  Seed: FATPMEAEL (CTG1B_HUMAN)
FQTPMEAEI

SEQ ID NO: 33074 - protein, 9 aa, Artificial Sequence
  Description of Artificial Sequence: Synthetic peptide
  Seed: SLAQDAPPL (CTG1B_HUMAN)
SRAQDAPPY

SEQ ID NO: 33075 - protein, 9 aa, Artificial Sequence
  Description of Artificial Sequence: Synthetic peptide
  Seed: LAQPPSGQR (CTG1B_HUMAN)
LIQPPSGQL

SEQ ID NO: 33076 - protein, 11 aa, Artificial Sequence
  Description of Artificial Sequence: Synthetic peptide
  Seed: FYLAMPFATPM (CTG1B_HUMAN)
FNLAMPFATPY

SEQ ID NO: 33077 - protein, 11 aa, Artificial Sequence
  Description of Artificial Sequence: Synthetic peptide
  Seed: RLLEFYLAMPF (CTG1B_HUMAN)
RHLEFYLAMPI

SEQ ID NO: 33078 - protein, 10 aa, Artificial Sequence
  Description of Artificial Sequence: Synthetic peptide
  Seed: GIPDGPGGNA (CTG1B_HUMAN)
GMPDGPGGNF

SEQ ID NO: 33079 - protein, 9 aa, Artificial Sequence
  Description of Artificial Sequence: Synthetic peptide
  Seed: RLLEFYLAM (CTG1B_HUMAN)
RSLEFYLAL

SEQ ID NO: 33080 - protein, 10 aa, Artificial Sequence
  Description of Artificial Sequence: Synthetic peptide
  Seed: RGPHGGAASG (CTG1B_HUMAN)
RNPHGGAASF

SEQ ID NO: 33081 - protein, 10 aa, Artificial Sequence
  Description of Artificial Sequence: Synthetic peptide
  Seed: LLEFYLAMPF (CTG1B_HUMAN)
LQEFYLAMPF

SEQ ID NO: 33082 - protein, 9 aa, Artificial Sequence
  Description of Artificial Sequence: Synthetic peptide
  Seed: MPFATPMEA (CTG1B_HUMAN)
MIFATPMEL

SEQ ID NO: 33083 - protein, 11 aa, Artificial Sequence
  Description of Artificial Sequence: Synthetic peptide
  Seed: QDAPPLPVPGV (CTG1B_HUMAN)
QEAPPLPVPGL

SEQ ID NO: 33084 - protein, 10 aa, Artificial Sequence
  Description of Artificial Sequence: Synthetic peptide
  Seed: ISSCLQQLSL (CTG1B_HUMAN)
IASCLQQLSF

SEQ ID NO: 33085 - protein, 9 aa, Artificial Sequence
  Description of Artificial Sequence: Synthetic peptide
  Seed: LLKEFTVSG (CTG1B_HUMAN)
LLKEFTVST

SEQ ID NO: 33086 - protein, 10 aa, Artificial Sequence
  Description of Artificial Sequence: Synthetic peptide
  Seed: RGPESRLLEF (CTG1B_HUMAN)
RCPESRLLEM

SEQ ID NO: 33087 - protein, 10 aa, Artificial Sequence
  Description of Artificial Sequence: Synthetic peptide
  Seed: YLAMPFATPM (CTG1B_HUMAN)
YHAMPFATPI

SEQ ID NO: 33088 - protein, 9 aa, Artificial Sequence
  Description of Artificial Sequence: Synthetic peptide
  Seed: FLPVFLAQP (CTG1B_HUMAN)
FMPVFLAQA

SEQ ID NO: 33089 - protein, 9 aa, Artificial Sequence
  Description of Artificial Sequence: Synthetic peptide
  Seed: FYLAMPFAT (CTG1B_HUMAN)
FWLAMPFAL

SEQ ID NO: 33090 - protein, 9 aa, Artificial Sequence
  Description of Artificial Sequence: Synthetic peptide
  Seed: AQDAPPLPV (CTG1B_HUMAN)
ALDAPPLPF

SEQ ID NO: 33091 - protein, 9 aa, Artificial Sequence
  Description of Artificial Sequence: Synthetic peptide
  Seed: LEFYLAMPF (CTG1B_HUMAN)
LTFYLAMPM

SEQ ID NO: 33092 - protein, 10 aa, Artificial Sequence
  Description of Artificial Sequence: Synthetic peptide
  Seed: FTVSGNILTI (CTG1B_HUMAN)
FAVSGNILTW

SEQ ID NO: 33093 - protein, 10 aa, Artificial Sequence
  Description of Artificial Sequence: Synthetic peptide
  Seed: ISSCLQQLSL (CTG1B_HUMAN)
IRSCLQQLSW

SEQ ID NO: 33094 - protein, 9 aa, Artificial Sequence
  Description of Artificial Sequence: Synthetic peptide
  Seed: GVLLKEFTV (CTG1B_HUMAN)
GMLLKEFTI

SEQ ID NO: 33095 - protein, 9 aa, Artificial Sequence
  Description of Artificial Sequence: Synthetic peptide
  Seed: LAMPFATPM (CTG1B_HUMAN)
LVMPFATPM

SEQ ID NO: 33096 - protein, 9 aa, Artificial Sequence
  Description of Artificial Sequence: Synthetic peptide
  Seed: LAMPFATPM (CTG1B_HUMAN)
LWMPFATPL

SEQ ID NO: 33097 - protein, 9 aa, Artificial Sequence
  Description of Artificial Sequence: Synthetic peptide
  Seed: TPMEAELAR (CTG1B_HUMAN)
TAMEAELAL

SEQ ID NO: 33098 - protein, 9 aa, Artificial Sequence
  Description of Artificial Sequence: Synthetic peptide
  Seed: AQDAPPLPV (CTG1B_HUMAN)
ACDAPPLPM

SEQ ID NO: 33099 - protein, 11 aa, Artificial Sequence
  Description of Artificial Sequence: Synthetic peptide
  Seed: GPRGAGAARAS (CTG1B_HUMAN)
GPRGAGAARAA

SEQ ID NO: 33100 - protein, 10 aa, Artificial Sequence
  Description of Artificial Sequence: Synthetic peptide
  Seed: GIPDGPGGNA (CTG1B_HUMAN)
GVPDGPGGNI

SEQ ID NO: 33101 - protein, 10 aa, Artificial Sequence
  Description of Artificial Sequence: Synthetic peptide
  Seed: YLAMPFATPM (CTG1B_HUMAN)
YMAMPFATPT

SEQ ID NO: 33102 - protein, 10 aa, Artificial Sequence
  Description of Artificial Sequence: Synthetic peptide
  Seed: RLLEFYLAMP (CTG1B_HUMAN)
RMLEFYLAMV

SEQ ID NO: 33103 - protein, 9 aa, Artificial Sequence
  Description of Artificial Sequence: Synthetic peptide
  Seed: SLAQDAPPL (CTG1B_HUMAN)
SAAQDAPPL

SEQ ID NO: 33104 - protein, 9 aa, Artificial Sequence
  Description of Artificial Sequence: Synthetic peptide
  Seed: ILTIRLTAA (CTG1B_HUMAN)
IMTIRLTAV

SEQ ID NO: 33105 - protein, 10 aa, Artificial Sequence
  Description of Artificial Sequence: Synthetic peptide
  Seed: RSLAQDAPPL (CTG1B_HUMAN)
RYLAQDAPPL

SEQ ID NO: 33106 - protein, 9 aa, Artificial Sequence
  Description of Artificial Sequence: Synthetic peptide
  Seed: LPVPGVLLK (CTG1B_HUMAN)
LAVPGVLLY

SEQ ID NO: 33107 - protein, 9 aa, Artificial Sequence
  Description of Artificial Sequence: Synthetic peptide
  Seed: LEFYLAMPF (CTG1B_HUMAN)
LPFYLAMPS

SEQ ID NO: 33108 - protein, 10 aa, Artificial Sequence
  Description of Artificial Sequence: Synthetic peptide
  Seed: RLTAADHRQL (CTG1B_HUMAN)
RSTAADHRQY

SEQ ID NO: 33109 - protein, 10 aa, Artificial Sequence
  Description of Artificial Sequence: Synthetic peptide
  Seed: YLAMPFATPM (CTG1B_HUMAN)
YCAMPFATPI

SEQ ID NO: 33110 - protein, 9 aa, Artificial Sequence
  Description of Artificial Sequence: Synthetic peptide
  Seed: AARASGPGG (CTG1B_HUMAN)
AMRASGPGK

SEQ ID NO: 33111 - protein, 9 aa, Artificial Sequence
  Description of Artificial Sequence: Synthetic peptide
  Seed: AQDAPPLPV (CTG1B_HUMAN)
AEDAPPLPI

SEQ ID NO: 33112 - protein, 10 aa, Artificial Sequence
  Description of Artificial Sequence: Synthetic peptide
  Seed: LLEFYLAMPF (CTG1B_HUMAN)
LPEFYLAMPL

SEQ ID NO: 33113 - protein, 9 aa, Artificial Sequence
  Description of Artificial Sequence: Synthetic peptide
  Seed: APPLPVPGV (CTG1B_HUMAN)
AIPLPVPGM

SEQ ID NO: 33114 - protein, 10 aa, Artificial Sequence
  Description of Artificial Sequence: Synthetic peptide
  Seed: SRLLEFYLAM (CTG1B_HUMAN)
STLLEFYLAL

SEQ ID NO: 33115 - protein, 9 aa, Artificial Sequence
  Description of Artificial Sequence: Synthetic peptide
  Seed: ITQCFLPVF (CTG1B_HUMAN)
IQQCFLPVL

SEQ ID NO: 33116 - protein, 10 aa, Artificial Sequence
  Description of Artificial Sequence: Synthetic peptide
  Seed: LLMWITQCFL (CTG1B_HUMAN)
LMMWITQCFL

SEQ ID NO: 33117 - protein, 11 aa, Artificial Sequence
  Description of Artificial Sequence: Synthetic peptide
  Seed: RLLEFYLAMPF (CTG1B_HUMAN)
RQLEFYLAMPI

SEQ ID NO: 33118 - protein, 9 aa, Artificial Sequence
  Description of Artificial Sequence: Synthetic peptide
  Seed: SGPGGGAPR (CTG1B_HUMAN)
SMPGGGAPL

SEQ ID NO: 33119 - protein, 9 aa, Artificial Sequence
  Description of Artificial Sequence: Synthetic peptide
  Seed: MQAEGRGTG (CTG1B_HUMAN)
MMAEGRGTF

SEQ ID NO: 33120 - protein, 11 aa, Artificial Sequence
  Description of Artificial Sequence: Synthetic peptide
  Seed: LLMWITQCFLP (CTG1B_HUMAN)
LIMWITQCFLV

SEQ ID NO: 33121 - protein, 9 aa, Artificial Sequence
  Description of Artificial Sequence: Synthetic peptide
  Seed: LAMPFATPM (CTG1B_HUMAN)
LHMPFATPM

SEQ ID NO: 33122 - protein, 10 aa, Artificial Sequence
  Description of Artificial Sequence: Synthetic peptide
  Seed: RGPESRLLEF (CTG1B_HUMAN)
RRPESRLLEY

SEQ ID NO: 33123 - protein, 9 aa, Artificial Sequence
  Description of Artificial Sequence: Synthetic peptide
  Seed: ITQCFLPVF (CTG1B_HUMAN)
IMQCFLPVY

SEQ ID NO: 33124 - protein, 10 aa, Artificial Sequence
  Description of Artificial Sequence: Synthetic peptide
  Seed: YLAMPFATPM (CTG1B_HUMAN)
YLAMPFATPT

SEQ ID NO: 33125 - protein, 9 aa, Artificial Sequence
  Description of Artificial Sequence: Synthetic peptide
  Seed: AQDAPPLPV (CTG1B_HUMAN)
ACDAPPLPI

SEQ ID NO: 33126 - protein, 9 aa, Artificial Sequence
  Description of Artificial Sequence: Synthetic peptide
  Seed: MPFATPMEA (CTG1B_HUMAN)
MAFATPMEW

SEQ ID NO: 33127 - protein, 9 aa, Artificial Sequence
  Description of Artificial Sequence: Synthetic peptide
  Seed: AQDAPPLPV (CTG1B_HUMAN)
ARDAPPLPL

SEQ ID NO: 33128 - protein, 9 aa, Artificial Sequence
  Description of Artificial Sequence: Synthetic peptide
  Seed: LAMPFATPM (CTG1B_HUMAN)
LHMPFATPI

SEQ ID NO: 33129 - protein, 11 aa, Artificial Sequence
  Description of Artificial Sequence: Synthetic peptide
  Seed: GDADGPGGPGI (CTG1B_HUMAN)
GEADGPGGPGL

SEQ ID NO: 33130 - protein, 9 aa, Artificial Sequence
  Description of Artificial Sequence: Synthetic peptide
  Seed: APPLPVPGV (CTG1B_HUMAN)
APPLPVPGM

SEQ ID NO: 33131 - protein, 9 aa, Artificial Sequence
  Description of Artificial Sequence: Synthetic peptide
  Seed: LAMPFATPM (CTG1B_HUMAN)
LLMPFATPR

SEQ ID NO: 33132 - protein, 10 aa, Artificial Sequence
  Description of Artificial Sequence: Synthetic peptide
  Seed: SLLMWITQCF (CTG1B_HUMAN)
SPLMWITQCY

SEQ ID NO: 33133 - protein, 10 aa, Artificial Sequence
  Description of Artificial Sequence: Synthetic peptide
  Seed: FLPVFLAQPP (CTG1B_HUMAN)
FPPVFLAQPA

SEQ ID NO: 33134 - protein, 9 aa, Artificial Sequence
  Description of Artificial Sequence: Synthetic peptide
  Seed: RASGPGGGA (CTG1B_HUMAN)
RPSGPGGGA

SEQ ID NO: 33135 - protein, 11 aa, Artificial Sequence
  Description of Artificial Sequence: Synthetic peptide
  Seed: FYLAMPFATPM (CTG1B_HUMAN)
FDLAMPFATPF

SEQ ID NO: 33136 - protein, 10 aa, Artificial Sequence
  Description of Artificial Sequence: Synthetic peptide
  Seed: KEFTVSGNIL (CTG1B_HUMAN)
KLFTVSGNIF

SEQ ID NO: 33137 - protein, 9 aa, Artificial Sequence
  Description of Artificial Sequence: Synthetic peptide
  Seed: LAMPFATPM (CTG1B_HUMAN)
LPMPFATPG

SEQ ID NO: 33138 - protein, 9 aa, Artificial Sequence
  Description of Artificial Sequence: Synthetic peptide
  Seed: MQAEGRGTG (CTG1B_HUMAN)
MEAEGRGTY

SEQ ID NO: 33139 - protein, 9 aa, Artificial Sequence
  Description of Artificial Sequence: Synthetic peptide
  Seed: LPVFLAQPP (CTG1B_HUMAN)
LPVFLAQPS

SEQ ID NO: 33140 - protein, 9 aa, Artificial Sequence
  Description of Artificial Sequence: Synthetic peptide
  Seed: LQLSISSCL (CTG1B_HUMAN)
LQLSISSCV

SEQ ID NO: 33141 - protein, 10 aa, Artificial Sequence
  Description of Artificial Sequence: Synthetic peptide
  Seed: FTVSGNILTI (CTG1B_HUMAN)
FRVSGNILTL

SEQ ID NO: 33142 - protein, 9 aa, Artificial Sequence
  Description of Artificial Sequence: Synthetic peptide
  Seed: ADGPGGPGI (CTG1B_HUMAN)
AEGPGGPGT

SEQ ID NO: 33143 - protein, 9 aa, Artificial Sequence
  Description of Artificial Sequence: Synthetic peptide
  Seed: LEFYLAMPF (CTG1B_HUMAN)
LQFYLAMPG

SEQ ID NO: 33144 - protein, 11 aa, Artificial Sequence
  Description of Artificial Sequence: Synthetic peptide
  Seed: RLLEFYLAMPF (CTG1B_HUMAN)
RYLEFYLAMPF

SEQ ID NO: 33145 - protein, 9 aa, Artificial Sequence
  Description of Artificial Sequence: Synthetic peptide
  Seed: LLKEFTVSG (CTG1B_HUMAN)
LMKEFTVSM

SEQ ID NO: 33146 - protein, 9 aa, Artificial Sequence
  Description of Artificial Sequence: Synthetic peptide
  Seed: LAMPFATPM (CTG1B_HUMAN)
LVMPFATPA

SEQ ID NO: 33147 - protein, 11 aa, Artificial Sequence
  Description of Artificial Sequence: Synthetic peptide
  Seed: SLAQDAPPLPV (CTG1B_HUMAN)
SMAQDAPPLPV

SEQ ID NO: 33148 - protein, 9 aa, Artificial Sequence
  Description of Artificial Sequence: Synthetic peptide
  Seed: RQLQLSISS (CTG1B_HUMAN)
RRLQLSISM

SEQ ID NO: 33149 - protein, 9 aa, Artificial Sequence
  Description of Artificial Sequence: Synthetic peptide
  Seed: AQDAPPLPV (CTG1B_HUMAN)
AFDAPPLPL

SEQ ID NO: 33150 - protein, 10 aa, Artificial Sequence
  Description of Artificial Sequence: Synthetic peptide
  Seed: ISSCLQQLSL (CTG1B_HUMAN)
IKSCLQQLSW

SEQ ID NO: 33151 - protein, 10 aa, Artificial Sequence
  Description of Artificial Sequence: Synthetic peptide
  Seed: ASGPGGGAPR (CTG1B_HUMAN)
ATGPGGGAPM

SEQ ID NO: 33152 - protein, 9 aa, Artificial Sequence
  Description of Artificial Sequence: Synthetic peptide
  Seed: MQAEGRGTG (CTG1B_HUMAN)
MRAEGRGTY

SEQ ID NO: 33153 - protein, 10 aa, Artificial Sequence
  Description of Artificial Sequence: Synthetic peptide
  Seed: RSLAQDAPPL (CTG1B_HUMAN)
RALAQDAPPW

SEQ ID NO: 33154 - protein, 10 aa, Artificial Sequence
  Description of Artificial Sequence: Synthetic peptide
  Seed: MPFATPMEAE (CTG1B_HUMAN)
MSFATPMEAY

SEQ ID NO: 33155 - protein, 9 aa, Artificial Sequence
  Description of Artificial Sequence: Synthetic peptide
  Seed: FTVSGNILT (CTG1B_HUMAN)
FVVSGNILA

SEQ ID NO: 33156 - protein, 10 aa, Artificial Sequence
  Description of Artificial Sequence: Synthetic peptide
  Seed: APPLPVPGVL (CTG1B_HUMAN)
AQPLPVPGVL

SEQ ID NO: 33157 - protein, 9 aa, Artificial Sequence
  Description of Artificial Sequence: Synthetic peptide
  Seed: TPMEAELAR (CTG1B_HUMAN)
TGMEAELAY

SEQ ID NO: 33158 - protein, 10 aa, Artificial Sequence
  Description of Artificial Sequence: Synthetic peptide
  Seed: YLAMPFATPM (CTG1B_HUMAN)
YAAMPFATPA

SEQ ID NO: 33159 - protein, 10 aa, Artificial Sequence
  Description of Artificial Sequence: Synthetic peptide
  Seed: LLMWITQCFL (CTG1B_HUMAN)
LVMWITQCFI

SEQ ID NO: 33160 - protein, 10 aa, Artificial Sequence
  Description of Artificial Sequence: Synthetic peptide
  Seed: LAMPFATPME (CTG1B_HUMAN)
LAMPFATPML

SEQ ID NO: 33161 - protein, 9 aa, Artificial Sequence
  Description of Artificial Sequence: Synthetic peptide
  Seed: LTAADHRQL (CTG1B_HUMAN)
LQAADHRQF

SEQ ID NO: 33162 - protein, 9 aa, Artificial Sequence
  Description of Artificial Sequence: Synthetic peptide
  Seed: TAADHRQLQ (CTG1B_HUMAN)
TVADHRQLF

SEQ ID NO: 33163 - protein, 10 aa, Artificial Sequence
  Description of Artificial Sequence: Synthetic peptide
  Seed: LLEFYLAMPF (CTG1B_HUMAN)
LEEFYLAMPL

SEQ ID NO: 33164 - protein, 11 aa, Artificial Sequence
  Description of Artificial Sequence: Synthetic peptide
  Seed: LAMPFATPMEA (CTG1B_HUMAN)
LYMPFATPMEA

SEQ ID NO: 33165 - protein, 9 aa, Artificial Sequence
  Description of Artificial Sequence: Synthetic peptide
  Seed: LQQLSLLMW (CTG1B_HUMAN)
LKQLSLLMY

SEQ ID NO: 33166 - protein, 9 aa, Artificial Sequence
  Description of Artificial Sequence: Synthetic peptide
  Seed: SISSCLQQL (CTG1B_HUMAN)
SISSCLQQR

SEQ ID NO: 33167 - protein, 9 aa, Artificial Sequence
  Description of Artificial Sequence: Synthetic peptide
  Seed: GPRGAGAAR (CTG1B_HUMAN)
GPRGAGAAF

SEQ ID NO: 33168 - protein, 9 aa, Artificial Sequence
  Description of Artificial Sequence: Synthetic peptide
  Seed: LEFYLAMPF (CTG1B_HUMAN)
LQFYLAMPV

SEQ ID NO: 33169 - protein, 10 aa, Artificial Sequence
  Description of Artificial Sequence: Synthetic peptide
  Seed: RGPHGGAASG (CTG1B_HUMAN)
RMPHGGAASL

SEQ ID NO: 33170 - protein, 9 aa, Artificial Sequence
  Description of Artificial Sequence: Synthetic peptide
  Seed: TVSGNILTI (CTG1B_HUMAN)
TGSGNILTF

SEQ ID NO: 33171 - protein, 9 aa, Artificial Sequence
  Description of Artificial Sequence: Synthetic peptide
  Seed: SGPGGGAPR (CTG1B_HUMAN)
SIPGGGAPM

SEQ ID NO: 33172 - protein, 10 aa, Artificial Sequence
  Description of Artificial Sequence: Synthetic peptide
  Seed: RGPHGGAASG (CTG1B_HUMAN)
RVPHGGAASL

SEQ ID NO: 33173 - protein, 11 aa, Artificial Sequence
  Description of Artificial Sequence: Synthetic peptide
  Seed: LAMPFATPMEA (CTG1B_HUMAN)
LRMPFATPMEA

SEQ ID NO: 33174 - protein, 10 aa, Artificial Sequence
  Description of Artificial Sequence: Synthetic peptide
  Seed: IPDGPGGNAG (CTG1B_HUMAN)
IPDGPGGNAF

SEQ ID NO: 33175 - protein, 10 aa, Artificial Sequence
  Description of Artificial Sequence: Synthetic peptide
  Seed: FYLAMPFATP (CTG1B_HUMAN)
FGLAMPFATM

SEQ ID NO: 33176 - protein, 9 aa, Artificial Sequence
  Description of Artificial Sequence: Synthetic peptide
  Seed: LAMPFATPM (CTG1B_HUMAN)
LQMPFATPG

SEQ ID NO: 33177 - protein, 9 aa, Artificial Sequence
  Description of Artificial Sequence: Synthetic peptide
  Seed: FATPMEAEL (CTG1B_HUMAN)
FLTPMEAEV

SEQ ID NO: 33178 - protein, 11 aa, Artificial Sequence
  Description of Artificial Sequence: Synthetic peptide
  Seed: RQLQLSISSCL (CTG1B_HUMAN)
RSLQLSISSCF

SEQ ID NO: 33179 - protein, 9 aa, Artificial Sequence
  Description of Artificial Sequence: Synthetic peptide
  Seed: AQDAPPLPV (CTG1B_HUMAN)
AIDAPPLPL

SEQ ID NO: 33180 - protein, 9 aa, Artificial Sequence
  Description of Artificial Sequence: Synthetic peptide
  Seed: AQDAPPLPV (CTG1B_HUMAN)
ATDAPPLPI

SEQ ID NO: 33181 - protein, 9 aa, Artificial Sequence
  Description of Artificial Sequence: Synthetic peptide
  Seed: FATPMEAEL (CTG1B_HUMAN)
FATPMEAEV

SEQ ID NO: 33182 - protein, 10 aa, Artificial Sequence
  Description of Artificial Sequence: Synthetic peptide
  Seed: RLLEFYLAMP (CTG1B_HUMAN)
RMLEFYLAMC

SEQ ID NO: 33183 - protein, 10 aa, Artificial Sequence
  Description of Artificial Sequence: Synthetic peptide
  Seed: APRGPHGGAA (CTG1B_HUMAN)
AARGPHGGAL

SEQ ID NO: 33184 - protein, 11 aa, Artificial Sequence
  Description of Artificial Sequence: Synthetic peptide
  Seed: RLLEFYLAMPF (CTG1B_HUMAN)
RPLEFYLAMPI

SEQ ID NO: 33185 - protein, 9 aa, Artificial Sequence
  Description of Artificial Sequence: Synthetic peptide
  Seed: SLLMWITQC (CTG1B_HUMAN)
SILMWITQA

SEQ ID NO: 33186 - protein, 9 aa, Artificial Sequence
  Description of Artificial Sequence: Synthetic peptide
  Seed: SISSCLQQL (CTG1B_HUMAN)
STSSCLQQL

SEQ ID NO: 33187 - protein, 9 aa, Artificial Sequence
  Description of Artificial Sequence: Synthetic peptide
  Seed: MPFATPMEA (CTG1B_HUMAN)
MHFATPMEM

SEQ ID NO: 33188 - protein, 9 aa, Artificial Sequence
  Description of Artificial Sequence: Synthetic peptide
  Seed: LLMWITQCF (CTG1B_HUMAN)
LIMWITQCF

SEQ ID NO: 33189 - protein, 9 aa, Artificial Sequence
  Description of Artificial Sequence: Synthetic peptide
  Seed: LAQPPSGQR (CTG1B_HUMAN)
LMQPPSGQR

SEQ ID NO: 33190 - protein, 10 aa, Artificial Sequence
  Description of Artificial Sequence: Synthetic peptide
  Seed: FLPVFLAQPP (CTG1B_HUMAN)
FWPVFLAQPV

SEQ ID NO: 33191 - protein, 9 aa, Artificial Sequence
  Description of Artificial Sequence: Synthetic peptide
  Seed: SLLMWITQC (CTG1B_HUMAN)
SILMWITQV

SEQ ID NO: 33192 - protein, 9 aa, Artificial Sequence
  Description of Artificial Sequence: Synthetic peptide
  Seed: AQDAPPLPV (CTG1B_HUMAN)
AEDAPPLPV

SEQ ID NO: 33193 - protein, 10 aa, Artificial Sequence
  Description of Artificial Sequence: Synthetic peptide
  Seed: FLPVFLAQPP (CTG1B_HUMAN)
FVPVFLAQPT

SEQ ID NO: 33194 - protein, 9 aa, Artificial Sequence
  Description of Artificial Sequence: Synthetic peptide
  Seed: RQLQLSISS (CTG1B_HUMAN)
RSLQLSISM

SEQ ID NO: 33195 - protein, 9 aa, Artificial Sequence
  Description of Artificial Sequence: Synthetic peptide
  Seed: SLAQDAPPL (CTG1B_HUMAN)
SSAQDAPPF

SEQ ID NO: 33196 - protein, 9 aa, Artificial Sequence
  Description of Artificial Sequence: Synthetic peptide
  Seed: SLAQDAPPL (CTG1B_HUMAN)
SVAQDAPPF

SEQ ID NO: 33197 - protein, 10 aa, Artificial Sequence
  Description of Artificial Sequence: Synthetic peptide
  Seed: FYLAMPFATP (CTG1B_HUMAN)
FELAMPFATV

SEQ ID NO: 33198 - protein, 10 aa, Artificial Sequence
  Description of Artificial Sequence: Synthetic peptide
  Seed: AGATGGRGPR (CTG1B_HUMAN)
ATATGGRGPR

SEQ ID NO: 33199 - protein, 9 aa, Artificial Sequence
  Description of Artificial Sequence: Synthetic peptide
  Seed: ILTIRLTAA (CTG1B_HUMAN)
IPTIRLTAM

SEQ ID NO: 33200 - protein, 9 aa, Artificial Sequence
  Description of Artificial Sequence: Synthetic peptide
  Seed: FLPVFLAQP (CTG1B_HUMAN)
FAPVFLAQV

SEQ ID NO: 33201 - protein, 11 aa, Artificial Sequence
  Description of Artificial Sequence: Synthetic peptide
  Seed: FATPMEAELAR (CTG1B_HUMAN)
FTTPMEAELAR

SEQ ID NO: 33202 - protein, 8 aa, Artificial Sequence
  Description of Artificial Sequence: Synthetic peptide
  Seed: MPFATPME (CTG1B_HUMAN)
MPFATPMM

SEQ ID NO: 33203 - protein, 10 aa, Artificial Sequence
  Description of Artificial Sequence: Synthetic peptide
  Seed: SLAQDAPPLP (CTG1B_HUMAN)
SLAQDAPPLI

SEQ ID NO: 33204 - protein, 10 aa, Artificial Sequence
  Description of Artificial Sequence: Synthetic peptide
  Seed: LAMPFATPME (CTG1B_HUMAN)
LAMPFATPMY

SEQ ID NO: 33205 - protein, 10 aa, Artificial Sequence
  Description of Artificial Sequence: Synthetic peptide
  Seed: YLAMPFATPM (CTG1B_HUMAN)
YHAMPFATPF

SEQ ID NO: 33206 - protein, 9 aa, Artificial Sequence
  Description of Artificial Sequence: Synthetic peptide
  Seed: LTAADHRQL (CTG1B_HUMAN)
LIAADHRQW

SEQ ID NO: 33207 - protein, 9 aa, Artificial Sequence
  Description of Artificial Sequence: Synthetic peptide
  Seed: TPMEAELAR (CTG1B_HUMAN)
TVMEAELAY

SEQ ID NO: 33208 - protein, 11 aa, Artificial Sequence
  Description of Artificial Sequence: Synthetic peptide
  Seed: IPDGPGGNAGG (CTG1B_HUMAN)
IPDGPGGNAGF

SEQ ID NO: 33209 - protein, 10 aa, Artificial Sequence
  Description of Artificial Sequence: Synthetic peptide
  Seed: LLMWITQCFL (CTG1B_HUMAN)
LFMWITQCFI

SEQ ID NO: 33210 - protein, 9 aa, Artificial Sequence
  Description of Artificial Sequence: Synthetic peptide
  Seed: LAMPFATPM (CTG1B_HUMAN)
LHMPFATPL

SEQ ID NO: 33211 - protein, 10 aa, Artificial Sequence
  Description of Artificial Sequence: Synthetic peptide
  Seed: RLLEFYLAMP (CTG1B_HUMAN)
RQLEFYLAMV

SEQ ID NO: 33212 - protein, 10 aa, Artificial Sequence
  Description of Artificial Sequence: Synthetic peptide
  Seed: FLAQPPSGQR (CTG1B_HUMAN)
FVAQPPSGQK

SEQ ID NO: 33213 - protein, 10 aa, Artificial Sequence
  Description of Artificial Sequence: Synthetic peptide
  Seed: YLAMPFATPM (CTG1B_HUMAN)
YHAMPFATPY

SEQ ID NO: 33214 - protein, 10 aa, Artificial Sequence
  Description of Artificial Sequence: Synthetic peptide
  Seed: YLAMPFATPM (CTG1B_HUMAN)
YSAMPFATPM

SEQ ID NO: 33215 - protein, 9 aa, Artificial Sequence
  Description of Artificial Sequence: Synthetic peptide
  Seed: AADHRQLQL (CTG1B_HUMAN)
AIDHRQLQY

SEQ ID NO: 33216 - protein, 9 aa, Artificial Sequence
  Description of Artificial Sequence: Synthetic peptide
  Seed: LEFYLAMPF (CTG1B_HUMAN)
LPFYLAMPT

SEQ ID NO: 33217 - protein, 8 aa, Artificial Sequence
  Description of Artificial Sequence: Synthetic peptide
  Seed: TQCFLPVF (CTG1B_HUMAN)
TQCFLPVI

SEQ ID NO: 33218 - protein, 10 aa, Artificial Sequence
  Description of Artificial Sequence: Synthetic peptide
  Seed: RGPESRLLEF (CTG1B_HUMAN)
RAPESRLLEY

SEQ ID NO: 33219 - protein, 11 aa, Artificial Sequence
  Description of Artificial Sequence: Synthetic peptide
  Seed: RQLQLSISSCL (CTG1B_HUMAN)
RGLQLSISSCF

SEQ ID NO: 33220 - protein, 9 aa, Artificial Sequence
  Description of Artificial Sequence: Synthetic peptide
  Seed: LLMWITQCF (CTG1B_HUMAN)
LKMWITQCL

SEQ ID NO: 33221 - protein, 11 aa, Artificial Sequence
  Description of Artificial Sequence: Synthetic peptide
  Seed: FYLAMPFATPM (CTG1B_HUMAN)
FSLAMPFATPL

SEQ ID NO: 33222 - protein, 9 aa, Artificial Sequence
  Description of Artificial Sequence: Synthetic peptide
  Seed: FLPVFLAQP (CTG1B_HUMAN)
FLPVFLAQS

SEQ ID NO: 33223 - protein, 10 aa, Artificial Sequence
  Description of Artificial Sequence: Synthetic peptide
  Seed: GAPRGPHGGA (CTG1B_HUMAN)
GGPRGPHGGL

SEQ ID NO: 33224 - protein, 9 aa, Artificial Sequence
  Description of Artificial Sequence: Synthetic peptide
  Seed: LQLSISSCL (CTG1B_HUMAN)
LSLSISSCF

SEQ ID NO: 33225 - protein, 11 aa, Artificial Sequence
  Description of Artificial Sequence: Synthetic peptide
  Seed: KEFTVSGNILT (CTG1B_HUMAN)
KEFTVSGNILV

SEQ ID NO: 33226 - protein, 9 aa, Artificial Sequence
  Description of Artificial Sequence: Synthetic peptide
  Seed: LAMPFATPM (CTG1B_HUMAN)
LEMPFATPF

SEQ ID NO: 33227 - protein, 10 aa, Artificial Sequence
  Description of Artificial Sequence: Synthetic peptide
  Seed: FTVSGNILTI (CTG1B_HUMAN)
FMVSGNILTY

SEQ ID NO: 33228 - protein, 8 aa, Artificial Sequence
  Description of Artificial Sequence: Synthetic peptide
  Seed: RLLEFYLA (CTG1B_HUMAN)
RLLEFYLI

SEQ ID NO: 33229 - protein, 10 aa, Artificial Sequence
  Description of Artificial Sequence: Synthetic peptide
  Seed: AASGLNGCCR (CTG1B_HUMAN)
ATSGLNGCCY

SEQ ID NO: 33230 - protein, 9 aa, Artificial Sequence
  Description of Artificial Sequence: Synthetic peptide
  Seed: TPMEAELAR (CTG1B_HUMAN)
TWMEAELAR

SEQ ID NO: 33231 - protein, 9 aa, Artificial Sequence
  Description of Artificial Sequence: Synthetic peptide
  Seed: FATPMEAEL (CTG1B_HUMAN)
FVTPMEAEV

SEQ ID NO: 33232 - protein, 9 aa, Artificial Sequence
  Description of Artificial Sequence: Synthetic peptide
  Seed: LQLSISSCL (CTG1B_HUMAN)
LILSISSCV

SEQ ID NO: 33233 - protein, 11 aa, Artificial Sequence
  Description of Artificial Sequence: Synthetic peptide
  Seed: RASGPGGGAPR (CTG1B_HUMAN)
RASGPGGGAPY

SEQ ID NO: 33234 - protein, 11 aa, Artificial Sequence
  Description of Artificial Sequence: Synthetic peptide
  Seed: RASGPGGGAPR (CTG1B_HUMAN)
RMSGPGGGAPK

SEQ ID NO: 33235 - protein, 9 aa, Artificial Sequence
  Description of Artificial Sequence: Synthetic peptide
  Seed: TVSGNILTI (CTG1B_HUMAN)
TQSGNILTI

SEQ ID NO: 33236 - protein, 9 aa, Artificial Sequence
  Description of Artificial Sequence: Synthetic peptide
  Seed: MPFATPMEA (CTG1B_HUMAN)
MNFATPMEY

SEQ ID NO: 33237 - protein, 10 aa, Artificial Sequence
  Description of Artificial Sequence: Synthetic peptide
  Seed: RSLAQDAPPL (CTG1B_HUMAN)
RFLAQDAPPL

SEQ ID NO: 33238 - protein, 10 aa, Artificial Sequence
  Description of Artificial Sequence: Synthetic peptide
  Seed: RGPHGGAASG (CTG1B_HUMAN)
RAPHGGAASM

SEQ ID NO: 33239 - protein, 9 aa, Artificial Sequence
  Description of Artificial Sequence: Synthetic peptide
  Seed: LAMPFATPM (CTG1B_HUMAN)
LVMPFATPT

SEQ ID NO: 33240 - protein, 11 aa, Artificial Sequence
  Description of Artificial Sequence: Synthetic peptide
  Seed: FYLAMPFATPM (CTG1B_HUMAN)
FALAMPFATPL

SEQ ID NO: 33241 - protein, 10 aa, Artificial Sequence
  Description of Artificial Sequence: Synthetic peptide
  Seed: FTVSGNILTI (CTG1B_HUMAN)
FRVSGNILTV

SEQ ID NO: 33242 - protein, 10 aa, Artificial Sequence
  Description of Artificial Sequence: Synthetic peptide
  Seed: FYLAMPFATP (CTG1B_HUMAN)
FQLAMPFATM

SEQ ID NO: 33243 - protein, 9 aa, Artificial Sequence
  Description of Artificial Sequence: Synthetic peptide
  Seed: AADHRQLQL (CTG1B_HUMAN)
ARDHRQLQM

SEQ ID NO: 33244 - protein, 10 aa, Artificial Sequence
  Description of Artificial Sequence: Synthetic peptide
  Seed: YLAMPFATPM (CTG1B_HUMAN)
YLAMPFATPF

SEQ ID NO: 33245 - protein, 10 aa, Artificial Sequence
  Description of Artificial Sequence: Synthetic peptide
  Seed: LEFYLAMPFA (CTG1B_HUMAN)
LQFYLAMPFT

SEQ ID NO: 33246 - protein, 10 aa, Artificial Sequence
  Description of Artificial Sequence: Synthetic peptide
  Seed: LLEFYLAMPF (CTG1B_HUMAN)
LVEFYLAMPL

SEQ ID NO: 33247 - protein, 9 aa, Artificial Sequence
  Description of Artificial Sequence: Synthetic peptide
  Seed: TVSGNILTI (CTG1B_HUMAN)
TMSGNILTM

SEQ ID NO: 33248 - protein, 11 aa, Artificial Sequence
  Description of Artificial Sequence: Synthetic peptide
  Seed: MPFATPMEAEL (CTG1B_HUMAN)
MAFATPMEAEF

SEQ ID NO: 33249 - protein, 10 aa, Artificial Sequence
  Description of Artificial Sequence: Synthetic peptide
  Seed: RSLAQDAPPL (CTG1B_HUMAN)
RQLAQDAPPV

SEQ ID NO: 33250 - protein, 9 aa, Artificial Sequence
  Description of Artificial Sequence: Synthetic peptide
  Seed: ESRLLEFYL (CTG1B_HUMAN)
ETRLLEFYI

SEQ ID NO: 33251 - protein, 9 aa, Artificial Sequence
  Description of Artificial Sequence: Synthetic peptide
  Seed: AQDAPPLPV (CTG1B_HUMAN)
ASDAPPLPM

SEQ ID NO: 33252 - protein, 11 aa, Artificial Sequence
  Description of Artificial Sequence: Synthetic peptide
  Seed: RLLEFYLAMPF (CTG1B_HUMAN)
RDLEFYLAMPY

SEQ ID NO: 33253 - protein, 11 aa, Artificial Sequence
  Description of Artificial Sequence: Synthetic peptide
  Seed: SLLMWITQCFL (CTG1B_HUMAN)
SFLMWITQCFI

SEQ ID NO: 33254 - protein, 9 aa, Artificial Sequence
  Description of Artificial Sequence: Synthetic peptide
  Seed: TPMEAELAR (CTG1B_HUMAN)
TMMEAELAR

SEQ ID NO: 33255 - protein, 9 aa, Artificial Sequence
  Description of Artificial Sequence: Synthetic peptide
  Seed: FATPMEAEL (CTG1B_HUMAN)
FQTPMEAEV

SEQ ID NO: 33256 - protein, 9 aa, Artificial Sequence
  Description of Artificial Sequence: Synthetic peptide
  Seed: ITQCFLPVF (CTG1B_HUMAN)
IAQCFLPVF

SEQ ID NO: 33257 - protein, 9 aa, Artificial Sequence
  Description of Artificial Sequence: Synthetic peptide
  Seed: ITQCFLPVF (CTG1B_HUMAN)
IAQCFLPVM

SEQ ID NO: 33258 - protein, 10 aa, Artificial Sequence
  Description of Artificial Sequence: Synthetic peptide
  Seed: LLEFYLAMPF (CTG1B_HUMAN)
LCEFYLAMPL

SEQ ID NO: 33259 - protein, 10 aa, Artificial Sequence
  Description of Artificial Sequence: Synthetic peptide
  Seed: RSLAQDAPPL (CTG1B_HUMAN)
RHLAQDAPPV

SEQ ID NO: 33260 - protein, 11 aa, Artificial Sequence
  Description of Artificial Sequence: Synthetic peptide
  Seed: RQLQLSISSCL (CTG1B_HUMAN)
RRLQLSISSCL

SEQ ID NO: 33261 - protein, 9 aa, Artificial Sequence
  Description of Artificial Sequence: Synthetic peptide
  Seed: RQLQLSISS (CTG1B_HUMAN)
RKLQLSISM

SEQ ID NO: 33262 - protein, 9 aa, Artificial Sequence
  Description of Artificial Sequence: Synthetic peptide
  Seed: YLAMPFATP (CTG1B_HUMAN)
YSAMPFATI

SEQ ID NO: 33263 - protein, 9 aa, Artificial Sequence
  Description of Artificial Sequence: Synthetic peptide
  Seed: FLPVFLAQP (CTG1B_HUMAN)
FTPVFLAQL

SEQ ID NO: 33264 - protein, 9 aa, Artificial Sequence
  Description of Artificial Sequence: Synthetic peptide
  Seed: GVLLKEFTV (CTG1B_HUMAN)
GLLLKEFTI

SEQ ID NO: 33265 - protein, 9 aa, Artificial Sequence
  Description of Artificial Sequence: Synthetic peptide
  Seed: FATPMEAEL (CTG1B_HUMAN)
FLTPMEAEI

SEQ ID NO: 33266 - protein, 10 aa, Artificial Sequence
  Description of Artificial Sequence: Synthetic peptide
  Seed: LLEFYLAMPF (CTG1B_HUMAN)
LIEFYLAMPY

SEQ ID NO: 33267 - protein, 9 aa, Artificial Sequence
  Description of Artificial Sequence: Synthetic peptide
  Seed: LAMPFATPM (CTG1B_HUMAN)
LLMPFATPC

SEQ ID NO: 33268 - protein, 11 aa, Artificial Sequence
  Description of Artificial Sequence: Synthetic peptide
  Seed: RASGPGGGAPR (CTG1B_HUMAN)
RVSGPGGGAPL

SEQ ID NO: 33269 - protein, 9 aa, Artificial Sequence
  Description of Artificial Sequence: Synthetic peptide
  Seed: AADHRQLQL (CTG1B_HUMAN)
AYDHRQLQF

SEQ ID NO: 33270 - protein, 10 aa, Artificial Sequence
  Description of Artificial Sequence: Synthetic peptide
  Seed: IPDGPGGNAG (CTG1B_HUMAN)
IPDGPGGNAL

SEQ ID NO: 33271 - protein, 9 aa, Artificial Sequence
  Description of Artificial Sequence: Synthetic peptide
  Seed: LPVFLAQPP (CTG1B_HUMAN)
LTVFLAQPY

SEQ ID NO: 33272 - protein, 10 aa, Artificial Sequence
  Description of Artificial Sequence: Synthetic peptide
  Seed: LLEFYLAMPF (CTG1B_HUMAN)
LHEFYLAMPL

SEQ ID NO: 33273 - protein, 9 aa, Artificial Sequence
  Description of Artificial Sequence: Synthetic peptide
  Seed: APPLPVPGV (CTG1B_HUMAN)
APPLPVPGA

SEQ ID NO: 33274 - protein, 10 aa, Artificial Sequence
  Description of Artificial Sequence: Synthetic peptide
  Seed: SRLLEFYLAM (CTG1B_HUMAN)
SNLLEFYLAI

SEQ ID NO: 33275 - protein, 11 aa, Artificial Sequence
  Description of Artificial Sequence: Synthetic peptide
  Seed: RLLEFYLAMPF (CTG1B_HUMAN)
RRLEFYLAMPM

SEQ ID NO: 33276 - protein, 9 aa, Artificial Sequence
  Description of Artificial Sequence: Synthetic peptide
  Seed: FTVSGNILT (CTG1B_HUMAN)
FMVSGNILT

SEQ ID NO: 33277 - protein, 10 aa, Artificial Sequence
  Description of Artificial Sequence: Synthetic peptide
  Seed: LQQLSLLMWI (CTG1B_HUMAN)
LFQLSLLMWL

SEQ ID NO: 33278 - protein, 11 aa, Artificial Sequence
  Description of Artificial Sequence: Synthetic peptide
  Seed: RQLQLSISSCL (CTG1B_HUMAN)
RQLQLSISSCF

SEQ ID NO: 33279 - protein, 9 aa, Artificial Sequence
  Description of Artificial Sequence: Synthetic peptide
  Seed: TPMEAELAR (CTG1B_HUMAN)
TTMEAELAK

SEQ ID NO: 33280 - protein, 10 aa, Artificial Sequence
  Description of Artificial Sequence: Synthetic peptide
  Seed: RGPHGGAASG (CTG1B_HUMAN)
RRPHGGAASV

SEQ ID NO: 33281 - protein, 9 aa, Artificial Sequence
  Description of Artificial Sequence: Synthetic peptide
  Seed: QQLSLLMWI (CTG1B_HUMAN)
QQLSLLMWL

SEQ ID NO: 33282 - protein, 10 aa, Artificial Sequence
  Description of Artificial Sequence: Synthetic peptide
  Seed: MWITQCFLPV (CTG1B_HUMAN)
MLITQCFLPV

SEQ ID NO: 33283 - protein, 10 aa, Artificial Sequence
  Description of Artificial Sequence: Synthetic peptide
  Seed: ASGPGGGAPR (CTG1B_HUMAN)
AYGPGGGAPY

SEQ ID NO: 33284 - protein, 9 aa, Artificial Sequence
  Description of Artificial Sequence: Synthetic peptide
  Seed: AQDAPPLPV (CTG1B_HUMAN)
ANDAPPLPI

SEQ ID NO: 33285 - protein, 11 aa, Artificial Sequence
  Description of Artificial Sequence: Synthetic peptide
  Seed: FYLAMPFATPM (CTG1B_HUMAN)
FQLAMPFATPM

SEQ ID NO: 33286 - protein, 9 aa, Artificial Sequence
  Description of Artificial Sequence: Synthetic peptide
  Seed: AQDAPPLPV (CTG1B_HUMAN)
ASDAPPLPF

SEQ ID NO: 33287 - protein, 11 aa, Artificial Sequence
  Description of Artificial Sequence: Synthetic peptide
  Seed: RQLQLSISSCL (CTG1B_HUMAN)
RYLQLSISSCY

SEQ ID NO: 33288 - protein, 9 aa, Artificial Sequence
  Description of Artificial Sequence: Synthetic peptide
  Seed: LLMWITQCF (CTG1B_HUMAN)
LVMWITQCL

SEQ ID NO: 33289 - protein, 9 aa, Artificial Sequence
  Description of Artificial Sequence: Synthetic peptide
  Seed: QQLSLLMWI (CTG1B_HUMAN)
QILSLLMWV

SEQ ID NO: 33290 - protein, 9 aa, Artificial Sequence
  Description of Artificial Sequence: Synthetic peptide
  Seed: SISSCLQQL (CTG1B_HUMAN)
STSSCLQQV

SEQ ID NO: 33291 - protein, 9 aa, Artificial Sequence
  Description of Artificial Sequence: Synthetic peptide
  Seed: VSGNILTIR (CTG1B_HUMAN)
VAGNILTIR

SEQ ID NO: 33292 - protein, 10 aa, Artificial Sequence
  Description of Artificial Sequence: Synthetic peptide
  Seed: FYLAMPFATP (CTG1B_HUMAN)
FFLAMPFATA

SEQ ID NO: 33293 - protein, 10 aa, Artificial Sequence
  Description of Artificial Sequence: Synthetic peptide
  Seed: GIPDGPGGNA (CTG1B_HUMAN)
GGPDGPGGNM

SEQ ID NO: 33294 - protein, 9 aa, Artificial Sequence
  Description of Artificial Sequence: Synthetic peptide
  Seed: SLAQDAPPL (CTG1B_HUMAN)
SAAQDAPPY

SEQ ID NO: 33295 - protein, 9 aa, Artificial Sequence
  Description of Artificial Sequence: Synthetic peptide
  Seed: LEFYLAMPF (CTG1B_HUMAN)
LIFYLAMPY

SEQ ID NO: 33296 - protein, 9 aa, Artificial Sequence
  Description of Artificial Sequence: Synthetic peptide
  Seed: ASGPGGGAP (CTG1B_HUMAN)
AAGPGGGAF

SEQ ID NO: 33297 - protein, 9 aa, Artificial Sequence
  Description of Artificial Sequence: Synthetic peptide
  Seed: RLLEFYLAM (CTG1B_HUMAN)
RFLEFYLAM

SEQ ID NO: 33298 - protein, 9 aa, Artificial Sequence
  Description of Artificial Sequence: Synthetic peptide
  Seed: SGPGGGAPR (CTG1B_HUMAN)
SAPGGGAPA

SEQ ID NO: 33299 - protein, 10 aa, Artificial Sequence
  Description of Artificial Sequence: Synthetic peptide
  Seed: FLPVFLAQPP (CTG1B_HUMAN)
FPPVFLAQPI

SEQ ID NO: 33300 - protein, 10 aa, Artificial Sequence
  Description of Artificial Sequence: Synthetic peptide
  Seed: APPLPVPGVL (CTG1B_HUMAN)
AIPLPVPGVL

SEQ ID NO: 33301 - protein, 8 aa, Artificial Sequence
  Description of Artificial Sequence: Synthetic peptide
  Seed: TAADHRQL (CTG1B_HUMAN)
TAADHRQM

SEQ ID NO: 33302 - protein, 11 aa, Artificial Sequence
  Description of Artificial Sequence: Synthetic peptide
  Seed: FYLAMPFATPM (CTG1B_HUMAN)
FKLAMPFATPI

SEQ ID NO: 33303 - protein, 9 aa, Artificial Sequence
  Description of Artificial Sequence: Synthetic peptide
  Seed: YLAMPFATP (CTG1B_HUMAN)
YTAMPFATV

SEQ ID NO: 33304 - protein, 9 aa, Artificial Sequence
  Description of Artificial Sequence: Synthetic peptide
  Seed: IPDGPGGNA (CTG1B_HUMAN)
IADGPGGNM

SEQ ID NO: 33305 - protein, 9 aa, Artificial Sequence
  Description of Artificial Sequence: Synthetic peptide
  Seed: AQDAPPLPV (CTG1B_HUMAN)
AADAPPLPY

SEQ ID NO: 33306 - protein, 9 aa, Artificial Sequence
  Description of Artificial Sequence: Synthetic peptide
  Seed: RLLEFYLAM (CTG1B_HUMAN)
RFLEFYLAF

SEQ ID NO: 33307 - protein, 10 aa, Artificial Sequence
  Description of Artificial Sequence: Synthetic peptide
  Seed: SRLLEFYLAM (CTG1B_HUMAN)
SMLLEFYLAT

SEQ ID NO: 33308 - protein, 11 aa, Artificial Sequence
  Description of Artificial Sequence: Synthetic peptide
  Seed: FYLAMPFATPM (CTG1B_HUMAN)
FNLAMPFATPF

SEQ ID NO: 33309 - protein, 11 aa, Artificial Sequence
  Description of Artificial Sequence: Synthetic peptide
  Seed: LTAADHRQLQL (CTG1B_HUMAN)
LSAADHRQLQW

SEQ ID NO: 33310 - protein, 10 aa, Artificial Sequence
  Description of Artificial Sequence: Synthetic peptide
  Seed: VSGNILTIRL (CTG1B_HUMAN)
VSGNILTIRW

SEQ ID NO: 33311 - protein, 10 aa, Artificial Sequence
  Description of Artificial Sequence: Synthetic peptide
  Seed: GAPRGPHGGA (CTG1B_HUMAN)
GMPRGPHGGL

SEQ ID NO: 33312 - protein, 10 aa, Artificial Sequence
  Description of Artificial Sequence: Synthetic peptide
  Seed: EFTVSGNILT (CTG1B_HUMAN)
EETVSGNILV

SEQ ID NO: 33313 - protein, 9 aa, Artificial Sequence
  Description of Artificial Sequence: Synthetic peptide
  Seed: LQLSISSCL (CTG1B_HUMAN)
LKLSISSCF

SEQ ID NO: 33314 - protein, 9 aa, Artificial Sequence
  Description of Artificial Sequence: Synthetic peptide
  Seed: MPFATPMEA (CTG1B_HUMAN)
MLFATPMEL

SEQ ID NO: 33315 - protein, 9 aa, Artificial Sequence
  Description of Artificial Sequence: Synthetic peptide
  Seed: LAMPFATPM (CTG1B_HUMAN)
LTMPFATPW

SEQ ID NO: 33316 - protein, 9 aa, Artificial Sequence
  Description of Artificial Sequence: Synthetic peptide
  Seed: RQLQLSISS (CTG1B_HUMAN)
RILQLSISL

SEQ ID NO: 33317 - protein, 10 aa, Artificial Sequence
  Description of Artificial Sequence: Synthetic peptide
  Seed: YLAMPFATPM (CTG1B_HUMAN)
YLAMPFATPI

SEQ ID NO: 33318 - protein, 9 aa, Artificial Sequence
  Description of Artificial Sequence: Synthetic peptide
  Seed: TVSGNILTI (CTG1B_HUMAN)
TRSGNILTL

SEQ ID NO: 33319 - protein, 10 aa, Artificial Sequence
  Description of Artificial Sequence: Synthetic peptide
  Seed: RLLEFYLAMP (CTG1B_HUMAN)
RTLEFYLAMI

SEQ ID NO: 33320 - protein, 9 aa, Artificial Sequence
  Description of Artificial Sequence: Synthetic peptide
  Seed: LEFYLAMPF (CTG1B_HUMAN)
LMFYLAMPL

SEQ ID NO: 33321 - protein, 10 aa, Artificial Sequence
  Description of Artificial Sequence: Synthetic peptide
  Seed: GIPDGPGGNA (CTG1B_HUMAN)
GFPDGPGGNL

SEQ ID NO: 33322 - protein, 10 aa, Artificial Sequence
  Description of Artificial Sequence: Synthetic peptide
  Seed: RASGPGGGAP (CTG1B_HUMAN)
RPSGPGGGAT

SEQ ID NO: 33323 - protein, 9 aa, Artificial Sequence
  Description of Artificial Sequence: Synthetic peptide
  Seed: YLAMPFATP (CTG1B_HUMAN)
YVAMPFATA

SEQ ID NO: 33324 - protein, 9 aa, Artificial Sequence
  Description of Artificial Sequence: Synthetic peptide
  Seed: SGPGGGAPR (CTG1B_HUMAN)
SFPGGGAPF

SEQ ID NO: 33325 - protein, 9 aa, Artificial Sequence
  Description of Artificial Sequence: Synthetic peptide
  Seed: SGPGGGAPR (CTG1B_HUMAN)
SFPGGGAPY

SEQ ID NO: 33326 - protein, 11 aa, Artificial Sequence
  Description of Artificial Sequence: Synthetic peptide
  Seed: GAPRGPHGGAA (CTG1B_HUMAN)
GTPRGPHGGAM

SEQ ID NO: 33327 - protein, 9 aa, Artificial Sequence
  Description of Artificial Sequence: Synthetic peptide
  Seed: TVSGNILTI (CTG1B_HUMAN)
TPSGNILTA

SEQ ID NO: 33328 - protein, 10 aa, Artificial Sequence
  Description of Artificial Sequence: Synthetic peptide
  Seed: GPRGAGAARA (CTG1B_HUMAN)
GPRGAGAARV

SEQ ID NO: 33329 - protein, 10 aa, Artificial Sequence
  Description of Artificial Sequence: Synthetic peptide
  Seed: LLEFYLAMPF (CTG1B_HUMAN)
LEEFYLAMPW

SEQ ID NO: 33330 - protein, 11 aa, Artificial Sequence
  Description of Artificial Sequence: Synthetic peptide
  Seed: RLLEFYLAMPF (CTG1B_HUMAN)
RYLEFYLAMPM

SEQ ID NO: 33331 - protein, 9 aa, Artificial Sequence
  Description of Artificial Sequence: Synthetic peptide
  Seed: IPDGPGGNA (CTG1B_HUMAN)
ISDGPGGNL

SEQ ID NO: 33332 - protein, 9 aa, Artificial Sequence
  Description of Artificial Sequence: Synthetic peptide
  Seed: LAMPFATPM (CTG1B_HUMAN)
LYMPFATPI

SEQ ID NO: 33333 - protein, 11 aa, Artificial Sequence
  Description of Artificial Sequence: Synthetic peptide
  Seed: FYLAMPFATPM (CTG1B_HUMAN)
FSLAMPFATPY

SEQ ID NO: 33334 - protein, 10 aa, Artificial Sequence
  Description of Artificial Sequence: Synthetic peptide
  Seed: APPLPVPGVL (CTG1B_HUMAN)
ASPLPVPGVL

SEQ ID NO: 33335 - protein, 9 aa, Artificial Sequence
  Description of Artificial Sequence: Synthetic peptide
  Seed: SLAQDAPPL (CTG1B_HUMAN)
SQAQDAPPY

SEQ ID NO: 33336 - protein, 9 aa, Artificial Sequence
  Description of Artificial Sequence: Synthetic peptide
  Seed: LMWITQCFL (CTG1B_HUMAN)
LMWITQCFR

SEQ ID NO: 33337 - protein, 9 aa, Artificial Sequence
  Description of Artificial Sequence: Synthetic peptide
  Seed: RLLEFYLAM (CTG1B_HUMAN)
RILEFYLAK

SEQ ID NO: 33338 - protein, 9 aa, Artificial Sequence
  Description of Artificial Sequence: Synthetic peptide
  Seed: GVLLKEFTV (CTG1B_HUMAN)
GMLLKEFTV

SEQ ID NO: 33339 - protein, 9 aa, Artificial Sequence
  Description of Artificial Sequence: Synthetic peptide
  Seed: AADHRQLQL (CTG1B_HUMAN)
AVDHRQLQF

SEQ ID NO: 33340 - protein, 10 aa, Artificial Sequence
  Description of Artificial Sequence: Synthetic peptide
  Seed: APPLPVPGVL (CTG1B_HUMAN)
AMPLPVPGVL

SEQ ID NO: 33341 - protein, 10 aa, Artificial Sequence
  Description of Artificial Sequence: Synthetic peptide
  Seed: FYLAMPFATP (CTG1B_HUMAN)
FILAMPFATL

SEQ ID NO: 33342 - protein, 11 aa, Artificial Sequence
  Description of Artificial Sequence: Synthetic peptide
  Seed: RLLEFYLAMPF (CTG1B_HUMAN)
RMLEFYLAMPW

SEQ ID NO: 33343 - protein, 10 aa, Artificial Sequence
  Description of Artificial Sequence: Synthetic peptide
  Seed: LSISSCLQQL (CTG1B_HUMAN)
LMISSCLQQA

SEQ ID NO: 33344 - protein, 9 aa, Artificial Sequence
  Description of Artificial Sequence: Synthetic peptide
  Seed: RQLQLSISS (CTG1B_HUMAN)
RQLQLSISV

SEQ ID NO: 33345 - protein, 10 aa, Artificial Sequence
  Description of Artificial Sequence: Synthetic peptide
  Seed: RSLAQDAPPL (CTG1B_HUMAN)
RSLAQDAPPF

SEQ ID NO: 33346 - protein, 10 aa, Artificial Sequence
  Description of Artificial Sequence: Synthetic peptide
  Seed: SLAQDAPPLP (CTG1B_HUMAN)
SMAQDAPPLL

SEQ ID NO: 33347 - protein, 9 aa, Artificial Sequence
  Description of Artificial Sequence: Synthetic peptide
  Seed: LAMPFATPM (CTG1B_HUMAN)
LAMPFATPL

SEQ ID NO: 33348 - protein, 11 aa, Artificial Sequence
  Description of Artificial Sequence: Synthetic peptide
  Seed: RASGPGGGAPR (CTG1B_HUMAN)
RLSGPGGGAPK

SEQ ID NO: 33349 - protein, 9 aa, Artificial Sequence
  Description of Artificial Sequence: Synthetic peptide
  Seed: FLPVFLAQP (CTG1B_HUMAN)
FMPVFLAQT

SEQ ID NO: 33350 - protein, 9 aa, Artificial Sequence
  Description of Artificial Sequence: Synthetic peptide
  Seed: IPDGPGGNA (CTG1B_HUMAN)
IGDGPGGNV

SEQ ID NO: 33351 - protein, 9 aa, Artificial Sequence
  Description of Artificial Sequence: Synthetic peptide
  Seed: WITQCFLPV (CTG1B_HUMAN)
WATQCFLPV

SEQ ID NO: 33352 - protein, 10 aa, Artificial Sequence
  Description of Artificial Sequence: Synthetic peptide
  Seed: FLPVFLAQPP (CTG1B_HUMAN)
FFPVFLAQPT

SEQ ID NO: 33353 - protein, 11 aa, Artificial Sequence
  Description of Artificial Sequence: Synthetic peptide
  Seed: RQLQLSISSCL (CTG1B_HUMAN)
RMLQLSISSCF

SEQ ID NO: 33354 - protein, 10 aa, Artificial Sequence
  Description of Artificial Sequence: Synthetic peptide
  Seed: FLAQPPSGQR (CTG1B_HUMAN)
FAAQPPSGQI

SEQ ID NO: 33355 - protein, 9 aa, Artificial Sequence
  Description of Artificial Sequence: Synthetic peptide
  Seed: FATPMEAEL (CTG1B_HUMAN)
FITPMEAEL

SEQ ID NO: 33356 - protein, 9 aa, Artificial Sequence
  Description of Artificial Sequence: Synthetic peptide
  Seed: QQLSLLMWI (CTG1B_HUMAN)
QTLSLLMWV

SEQ ID NO: 33357 - protein, 11 aa, Artificial Sequence
  Description of Artificial Sequence: Synthetic peptide
  Seed: GAPRGPHGGAA (CTG1B_HUMAN)
GSPRGPHGGAI

SEQ ID NO: 33358 - protein, 9 aa, Artificial Sequence
  Description of Artificial Sequence: Synthetic peptide
  Seed: ARGPESRLL (CTG1B_HUMAN)
AYGPESRLY

SEQ ID NO: 33359 - protein, 9 aa, Artificial Sequence
  Description of Artificial Sequence: Synthetic peptide
  Seed: LLMWITQCF (CTG1B_HUMAN)
LRMWITQCY

SEQ ID NO: 33360 - protein, 9 aa, Artificial Sequence
  Description of Artificial Sequence: Synthetic peptide
  Seed: CLQQLSLLM (CTG1B_HUMAN)
CQQQLSLLF

SEQ ID NO: 33361 - protein, 9 aa, Artificial Sequence
  Description of Artificial Sequence: Synthetic peptide
  Seed: ESRLLEFYL (CTG1B_HUMAN)
EVRLLEFYV

SEQ ID NO: 33362 - protein, 9 aa, Artificial Sequence
  Description of Artificial Sequence: Synthetic peptide
  Seed: SISSCLQQL (CTG1B_HUMAN)
SQSSCLQQA

SEQ ID NO: 33363 - protein, 9 aa, Artificial Sequence
  Description of Artificial Sequence: Synthetic peptide
  Seed: MQAEGRGTG (CTG1B_HUMAN)
MGAEGRGTY

SEQ ID NO: 33364 - protein, 10 aa, Artificial Sequence
  Description of Artificial Sequence: Synthetic peptide
  Seed: FYLAMPFATP (CTG1B_HUMAN)
FQLAMPFATT

SEQ ID NO: 33365 - protein, 10 aa, Artificial Sequence
  Description of Artificial Sequence: Synthetic peptide
  Seed: GAPRGPHGGA (CTG1B_HUMAN)
GQPRGPHGGL

SEQ ID NO: 33366 - protein, 9 aa, Artificial Sequence
  Description of Artificial Sequence: Synthetic peptide
  Seed: LLKEFTVSG (CTG1B_HUMAN)
LTKEFTVSV

SEQ ID NO: 33367 - protein, 10 aa, Artificial Sequence
  Description of Artificial Sequence: Synthetic peptide
  Seed: YLAMPFATPM (CTG1B_HUMAN)
YDAMPFATPL

SEQ ID NO: 33368 - protein, 9 aa, Artificial Sequence
  Description of Artificial Sequence: Synthetic peptide
  Seed: YLAMPFATP (CTG1B_HUMAN)
YQAMPFATM

SEQ ID NO: 33369 - protein, 10 aa, Artificial Sequence
  Description of Artificial Sequence: Synthetic peptide
  Seed: ASGPGGGAPR (CTG1B_HUMAN)
AIGPGGGAPK

SEQ ID NO: 33370 - protein, 10 aa, Artificial Sequence
  Description of Artificial Sequence: Synthetic peptide
  Seed: RGPESRLLEF (CTG1B_HUMAN)
REPESRLLEL

SEQ ID NO: 33371 - protein, 9 aa, Artificial Sequence
  Description of Artificial Sequence: Synthetic peptide
  Seed: FYLAMPFAT (CTG1B_HUMAN)
FYLAMPFAL

SEQ ID NO: 33372 - protein, 10 aa, Artificial Sequence
  Description of Artificial Sequence: Synthetic peptide
  Seed: RGPHGGAASG (CTG1B_HUMAN)
RKPHGGAASI

SEQ ID NO: 33373 - protein, 10 aa, Artificial Sequence
  Description of Artificial Sequence: Synthetic peptide
  Seed: AMPFATPMEA (CTG1B_HUMAN)
AWPFATPMEF

SEQ ID NO: 33374 - protein, 10 aa, Artificial Sequence
  Description of Artificial Sequence: Synthetic peptide
  Seed: FYLAMPFATP (CTG1B_HUMAN)
FSLAMPFATT

SEQ ID NO: 33375 - protein, 9 aa, Artificial Sequence
  Description of Artificial Sequence: Synthetic peptide
  Seed: RLLEFYLAM (CTG1B_HUMAN)
RGLEFYLAM

SEQ ID NO: 33376 - protein, 9 aa, Artificial Sequence
  Description of Artificial Sequence: Synthetic peptide
  Seed: QQLSLLMWI (CTG1B_HUMAN)
QQLSLLMWF

SEQ ID NO: 33377 - protein, 10 aa, Artificial Sequence
  Description of Artificial Sequence: Synthetic peptide
  Seed: LAQPPSGQRR (CTG1B_HUMAN)
LAQPPSGQRL

SEQ ID NO: 33378 - protein, 9 aa, Artificial Sequence
  Description of Artificial Sequence: Synthetic peptide
  Seed: LQLSISSCL (CTG1B_HUMAN)
LMLSISSCM

SEQ ID NO: 33379 - protein, 10 aa, Artificial Sequence
  Description of Artificial Sequence: Synthetic peptide
  Seed: MPFATPMEAE (CTG1B_HUMAN)
MPFATPMEAN

SEQ ID NO: 33380 - protein, 11 aa, Artificial Sequence
  Description of Artificial Sequence: Synthetic peptide
  Seed: GAPRGPHGGAA (CTG1B_HUMAN)
GMPRGPHGGAV

SEQ ID NO: 33381 - protein, 9 aa, Artificial Sequence
  Description of Artificial Sequence: Synthetic peptide
  Seed: AARASGPGG (CTG1B_HUMAN)
AARASGPGA

SEQ ID NO: 33382 - protein, 10 aa, Artificial Sequence
  Description of Artificial Sequence: Synthetic peptide
  Seed: RGPESRLLEF (CTG1B_HUMAN)
RIPESRLLEL

SEQ ID NO: 33383 - protein, 9 aa, Artificial Sequence
  Description of Artificial Sequence: Synthetic peptide
  Seed: FTVSGNILT (CTG1B_HUMAN)
FIVSGNILA

SEQ ID NO: 33384 - protein, 8 aa, Artificial Sequence
  Description of Artificial Sequence: Synthetic peptide
  Seed: YLAMPFAT (CTG1B_HUMAN)
YLAMPFAL

SEQ ID NO: 33385 - protein, 9 aa, Artificial Sequence
  Description of Artificial Sequence: Synthetic peptide
  Seed: SSCLQQLSL (CTG1B_HUMAN)
SLCLQQLSF

SEQ ID NO: 33386 - protein, 9 aa, Artificial Sequence
  Description of Artificial Sequence: Synthetic peptide
  Seed: SISSCLQQL (CTG1B_HUMAN)
SVSSCLQQM

SEQ ID NO: 33387 - protein, 9 aa, Artificial Sequence
  Description of Artificial Sequence: Synthetic peptide
  Seed: LAMPFATPM (CTG1B_HUMAN)
LFMPFATPA

SEQ ID NO: 33388 - protein, 11 aa, Artificial Sequence
  Description of Artificial Sequence: Synthetic peptide
  Seed: RLLEFYLAMPF (CTG1B_HUMAN)
RILEFYLAMPV

SEQ ID NO: 33389 - protein, 10 aa, Artificial Sequence
  Description of Artificial Sequence: Synthetic peptide
  Seed: GPRGAGAARA (CTG1B_HUMAN)
GPRGAGAARL

SEQ ID NO: 33390 - protein, 9 aa, Artificial Sequence
  Description of Artificial Sequence: Synthetic peptide
  Seed: QDAPPLPVP (CTG1B_HUMAN)
QEAPPLPVI

SEQ ID NO: 33391 - protein, 9 aa, Artificial Sequence
  Description of Artificial Sequence: Synthetic peptide
  Seed: LPVPGVLLK (CTG1B_HUMAN)
LAVPGVLLR

SEQ ID NO: 33392 - protein, 10 aa, Artificial Sequence
  Description of Artificial Sequence: Synthetic peptide
  Seed: FYLAMPFATP (CTG1B_HUMAN)
FNLAMPFATI

SEQ ID NO: 33393 - protein, 9 aa, Artificial Sequence
  Description of Artificial Sequence: Synthetic peptide
  Seed: SLLMWITQC (CTG1B_HUMAN)
SVLMWITQL

SEQ ID NO: 33394 - protein, 9 aa, Artificial Sequence
  Description of Artificial Sequence: Synthetic peptide
  Seed: LPVPGVLLK (CTG1B_HUMAN)
LTVPGVLLI

SEQ ID NO: 33395 - protein, 9 aa, Artificial Sequence
  Description of Artificial Sequence: Synthetic peptide
  Seed: ASGPGGGAP (CTG1B_HUMAN)
AAGPGGGAI

SEQ ID NO: 33396 - protein, 10 aa, Artificial Sequence
  Description of Artificial Sequence: Synthetic peptide
  Seed: ASGPGGGAPR (CTG1B_HUMAN)
ASGPGGGAPL

SEQ ID NO: 33397 - protein, 9 aa, Artificial Sequence
  Description of Artificial Sequence: Synthetic peptide
  Seed: AQDAPPLPV (CTG1B_HUMAN)
AFDAPPLPF

SEQ ID NO: 33398 - protein, 9 aa, Artificial Sequence
  Description of Artificial Sequence: Synthetic peptide
  Seed: RQLQLSISS (CTG1B_HUMAN)
RELQLSISM

SEQ ID NO: 33399 - protein, 10 aa, Artificial Sequence
  Description of Artificial Sequence: Synthetic peptide
  Seed: SLLMWITQCF (CTG1B_HUMAN)
STLMWITQCY

SEQ ID NO: 33400 - protein, 10 aa, Artificial Sequence
  Description of Artificial Sequence: Synthetic peptide
  Seed: FLPVFLAQPP (CTG1B_HUMAN)
FMPVFLAQPT

SEQ ID NO: 33401 - protein, 10 aa, Artificial Sequence
  Description of Artificial Sequence: Synthetic peptide
  Seed: SLLMWITQCF (CTG1B_HUMAN)
SKLMWITQCF

SEQ ID NO: 33402 - protein, 9 aa, Artificial Sequence
  Description of Artificial Sequence: Synthetic peptide
  Seed: RQLQLSISS (CTG1B_HUMAN)
RGLQLSISY

SEQ ID NO: 33403 - protein, 10 aa, Artificial Sequence
  Description of Artificial Sequence: Synthetic peptide
  Seed: LQQLSLLMWI (CTG1B_HUMAN)
LHQLSLLMWV

SEQ ID NO: 33404 - protein, 11 aa, Artificial Sequence
  Description of Artificial Sequence: Synthetic peptide
  Seed: YLAMPFATPME (CTG1B_HUMAN)
YQAMPFATPMV

SEQ ID NO: 33405 - protein, 10 aa, Artificial Sequence
  Description of Artificial Sequence: Synthetic peptide
  Seed: RGPHGGAASG (CTG1B_HUMAN)
RVPHGGAASM

SEQ ID NO: 33406 - protein, 9 aa, Artificial Sequence
  Description of Artificial Sequence: Synthetic peptide
  Seed: FTVSGNILT (CTG1B_HUMAN)
FMVSGNILM

SEQ ID NO: 33407 - protein, 9 aa, Artificial Sequence
  Description of Artificial Sequence: Synthetic peptide
  Seed: LTAADHRQL (CTG1B_HUMAN)
LSAADHRQL

SEQ ID NO: 33408 - protein, 9 aa, Artificial Sequence
  Description of Artificial Sequence: Synthetic peptide
  Seed: LLMWITQCF (CTG1B_HUMAN)
LLMWITQCV

SEQ ID NO: 33409 - protein, 9 aa, Artificial Sequence
  Description of Artificial Sequence: Synthetic peptide
  Seed: LAMPFATPM (CTG1B_HUMAN)
LSMPFATPM

SEQ ID NO: 33410 - protein, 10 aa, Artificial Sequence
  Description of Artificial Sequence: Synthetic peptide
  Seed: FTVSGNILTI (CTG1B_HUMAN)
FVVSGNILTF

SEQ ID NO: 33411 - protein, 9 aa, Artificial Sequence
  Description of Artificial Sequence: Synthetic peptide
  Seed: RLLEFYLAM (CTG1B_HUMAN)
RMLEFYLAA

SEQ ID NO: 33412 - protein, 11 aa, Artificial Sequence
  Description of Artificial Sequence: Synthetic peptide
  Seed: YLAMPFATPME (CTG1B_HUMAN)
YIAMPFATPMV

SEQ ID NO: 33413 - protein, 9 aa, Artificial Sequence
  Description of Artificial Sequence: Synthetic peptide
  Seed: AARASGPGG (CTG1B_HUMAN)
AYRASGPGA

SEQ ID NO: 33414 - protein, 10 aa, Artificial Sequence
  Description of Artificial Sequence: Synthetic peptide
  Seed: SRLLEFYLAM (CTG1B_HUMAN)
SRLLEFYLAV

SEQ ID NO: 33415 - protein, 9 aa, Artificial Sequence
  Description of Artificial Sequence: Synthetic peptide
  Seed: TAADHRQLQ (CTG1B_HUMAN)
TAADHRQLY

SEQ ID NO: 33416 - protein, 11 aa, Artificial Sequence
  Description of Artificial Sequence: Synthetic peptide
  Seed: FYLAMPFATPM (CTG1B_HUMAN)
FSLAMPFATPI

SEQ ID NO: 33417 - protein, 9 aa, Artificial Sequence
  Description of Artificial Sequence: Synthetic peptide
  Seed: SGNILTIRL (CTG1B_HUMAN)
SANILTIRL

SEQ ID NO: 33418 - protein, 11 aa, Artificial Sequence
  Description of Artificial Sequence: Synthetic peptide
  Seed: GAPRGPHGGAA (CTG1B_HUMAN)
GHPRGPHGGAM

SEQ ID NO: 33419 - protein, 9 aa, Artificial Sequence
  Description of Artificial Sequence: Synthetic peptide
  Seed: FATPMEAEL (CTG1B_HUMAN)
FLTPMEAEM

SEQ ID NO: 33420 - protein, 9 aa, Artificial Sequence
  Description of Artificial Sequence: Synthetic peptide
  Seed: AQDAPPLPV (CTG1B_HUMAN)
ALDAPPLPI

SEQ ID NO: 33421 - protein, 11 aa, Artificial Sequence
  Description of Artificial Sequence: Synthetic peptide
  Seed: RLLEFYLAMPF (CTG1B_HUMAN)
RILEFYLAMPI

SEQ ID NO: 33422 - protein, 9 aa, Artificial Sequence
  Description of Artificial Sequence: Synthetic peptide
  Seed: MPFATPMEA (CTG1B_HUMAN)
MMFATPMEV

SEQ ID NO: 33423 - protein, 9 aa, Artificial Sequence
  Description of Artificial Sequence: Synthetic peptide
  Seed: SGPGGGAPR (CTG1B_HUMAN)
SMPGGGAPY

SEQ ID NO: 33424 - protein, 9 aa, Artificial Sequence
  Description of Artificial Sequence: Synthetic peptide
  Seed: LLMWITQCF (CTG1B_HUMAN)
LAMWITQCF

SEQ ID NO: 33425 - protein, 10 aa, Artificial Sequence
  Description of Artificial Sequence: Synthetic peptide
  Seed: MWITQCFLPV (CTG1B_HUMAN)
MMITQCFLPM

SEQ ID NO: 33426 - protein, 10 aa, Artificial Sequence
  Description of Artificial Sequence: Synthetic peptide
  Seed: FLPVFLAQPP (CTG1B_HUMAN)
FIPVFLAQPV

SEQ ID NO: 33427 - protein, 9 aa, Artificial Sequence
  Description of Artificial Sequence: Synthetic peptide
  Seed: LAMPFATPM (CTG1B_HUMAN)
LFMPFATPV

SEQ ID NO: 33428 - protein, 10 aa, Artificial Sequence
  Description of Artificial Sequence: Synthetic peptide
  Seed: LQQLSLLMWI (CTG1B_HUMAN)
LTQLSLLMWV

SEQ ID NO: 33429 - protein, 9 aa, Artificial Sequence
  Description of Artificial Sequence: Synthetic peptide
  Seed: MPFATPMEA (CTG1B_HUMAN)
MMFATPMEI

SEQ ID NO: 33430 - protein, 10 aa, Artificial Sequence
  Description of Artificial Sequence: Synthetic peptide
  Seed: TPMEAELARR (CTG1B_HUMAN)
TAMEAELARR

SEQ ID NO: 33431 - protein, 10 aa, Artificial Sequence
  Description of Artificial Sequence: Synthetic peptide
  Seed: YLAMPFATPM (CTG1B_HUMAN)
YIAMPFATPW

SEQ ID NO: 33432 - protein, 11 aa, Artificial Sequence
  Description of Artificial Sequence: Synthetic peptide
  Seed: FYLAMPFATPM (CTG1B_HUMAN)
FVLAMPFATPV

SEQ ID NO: 33433 - protein, 11 aa, Artificial Sequence
  Description of Artificial Sequence: Synthetic peptide
  Seed: RASGPGGGAPR (CTG1B_HUMAN)
RASGPGGGAPF

SEQ ID NO: 33434 - protein, 10 aa, Artificial Sequence
  Description of Artificial Sequence: Synthetic peptide
  Seed: FYLAMPFATP (CTG1B_HUMAN)
FGLAMPFATT

SEQ ID NO: 33435 - protein, 10 aa, Artificial Sequence
  Description of Artificial Sequence: Synthetic peptide
  Seed: FTVSGNILTI (CTG1B_HUMAN)
FSVSGNILTY

SEQ ID NO: 33436 - protein, 10 aa, Artificial Sequence
  Description of Artificial Sequence: Synthetic peptide
  Seed: RGPESRLLEF (CTG1B_HUMAN)
RCPESRLLEL

SEQ ID NO: 33437 - protein, 9 aa, Artificial Sequence
  Description of Artificial Sequence: Synthetic peptide
  Seed: RQLQLSISS (CTG1B_HUMAN)
RKLQLSISF

SEQ ID NO: 33438 - protein, 11 aa, Artificial Sequence
  Description of Artificial Sequence: Synthetic peptide
  Seed: ARASGPGGGAP (CTG1B_HUMAN)
ARASGPGGGAY

SEQ ID NO: 33439 - protein, 10 aa, Artificial Sequence
  Description of Artificial Sequence: Synthetic peptide
  Seed: FYLAMPFATP (CTG1B_HUMAN)
FYLAMPFATT

SEQ ID NO: 33440 - protein, 11 aa, Artificial Sequence
  Description of Artificial Sequence: Synthetic peptide
  Seed: GGRGPRGAGAA (CTG1B_HUMAN)
GPRGPRGAGAV

SEQ ID NO: 33441 - protein, 9 aa, Artificial Sequence
  Description of Artificial Sequence: Synthetic peptide
  Seed: LAMPFATPM (CTG1B_HUMAN)
LMMPFATPG

SEQ ID NO: 33442 - protein, 9 aa, Artificial Sequence
  Description of Artificial Sequence: Synthetic peptide
  Seed: LAMPFATPM (CTG1B_HUMAN)
LSMPFATPV

SEQ ID NO: 33443 - protein, 9 aa, Artificial Sequence
  Description of Artificial Sequence: Synthetic peptide
  Seed: DAPPLPVPG (CTG1B_HUMAN)
DAPPLPVPV

SEQ ID NO: 33444 - protein, 9 aa, Artificial Sequence
  Description of Artificial Sequence: Synthetic peptide
  Seed: LPVPGVLLK (CTG1B_HUMAN)
LPVPGVLLI

SEQ ID NO: 33445 - protein, 10 aa, Artificial Sequence
  Description of Artificial Sequence: Synthetic peptide
  Seed: MWITQCFLPV (CTG1B_HUMAN)
MQITQCFLPV

SEQ ID NO: 33446 - protein, 9 aa, Artificial Sequence
  Description of Artificial Sequence: Synthetic peptide
  Seed: SSCLQQLSL (CTG1B_HUMAN)
SICLQQLSW

SEQ ID NO: 33447 - protein, 10 aa, Artificial Sequence
  Description of Artificial Sequence: Synthetic peptide
  Seed: YLAMPFATPM (CTG1B_HUMAN)
YDAMPFATPW

SEQ ID NO: 33448 - protein, 9 aa, Artificial Sequence
  Description of Artificial Sequence: Synthetic peptide
  Seed: FLPVFLAQP (CTG1B_HUMAN)
FIPVFLAQI

SEQ ID NO: 33449 - protein, 10 aa, Artificial Sequence
  Description of Artificial Sequence: Synthetic peptide
  Seed: ASGPGGGAPR (CTG1B_HUMAN)
ATGPGGGAPR

SEQ ID NO: 33450 - protein, 11 aa, Artificial Sequence
  Description of Artificial Sequence: Synthetic peptide
  Seed: RLLEFYLAMPF (CTG1B_HUMAN)
RGLEFYLAMPI

SEQ ID NO: 33451 - protein, 9 aa, Artificial Sequence
  Description of Artificial Sequence: Synthetic peptide
  Seed: MPFATPMEA (CTG1B_HUMAN)
MPFATPMEE

SEQ ID NO: 33452 - protein, 9 aa, Artificial Sequence
  Description of Artificial Sequence: Synthetic peptide
  Seed: QDAPPLPVP (CTG1B_HUMAN)
QEAPPLPVV

SEQ ID NO: 33453 - protein, 9 aa, Artificial Sequence
  Description of Artificial Sequence: Synthetic peptide
  Seed: LLMWITQCF (CTG1B_HUMAN)
LLMWITQCL

SEQ ID NO: 33454 - protein, 10 aa, Artificial Sequence
  Description of Artificial Sequence: Synthetic peptide
  Seed: MPFATPMEAE (CTG1B_HUMAN)
MPFATPMEAI

SEQ ID NO: 33455 - protein, 9 aa, Artificial Sequence
  Description of Artificial Sequence: Synthetic peptide
  Seed: FLPVFLAQP (CTG1B_HUMAN)
FLPVFLAQL

SEQ ID NO: 33456 - protein, 11 aa, Artificial Sequence
  Description of Artificial Sequence: Synthetic peptide
  Seed: FYLAMPFATPM (CTG1B_HUMAN)
FMLAMPFATPY

SEQ ID NO: 33457 - protein, 10 aa, Artificial Sequence
  Description of Artificial Sequence: Synthetic peptide
  Seed: LEFYLAMPFA (CTG1B_HUMAN)
LMFYLAMPFF

SEQ ID NO: 33458 - protein, 9 aa, Artificial Sequence
  Description of Artificial Sequence: Synthetic peptide
  Seed: RLLEFYLAM (CTG1B_HUMAN)
RMLEFYLAC

SEQ ID NO: 33459 - protein, 10 aa, Artificial Sequence
  Description of Artificial Sequence: Synthetic peptide
  Seed: GAPRGPHGGA (CTG1B_HUMAN)
GRPRGPHGGF

SEQ ID NO: 33460 - protein, 10 aa, Artificial Sequence
  Description of Artificial Sequence: Synthetic peptide
  Seed: RGPHGGAASG (CTG1B_HUMAN)
RCPHGGAASV

SEQ ID NO: 33461 - protein, 9 aa, Artificial Sequence
  Description of Artificial Sequence: Synthetic peptide
  Seed: RQLQLSISS (CTG1B_HUMAN)
RILQLSISV

SEQ ID NO: 33462 - protein, 11 aa, Artificial Sequence
  Description of Artificial Sequence: Synthetic peptide
  Seed: RLLEFYLAMPF (CTG1B_HUMAN)
RSLEFYLAMPF

SEQ ID NO: 33463 - protein, 9 aa, Artificial Sequence
  Description of Artificial Sequence: Synthetic peptide
  Seed: LLKEFTVSG (CTG1B_HUMAN)
LLKEFTVSA

SEQ ID NO: 33464 - protein, 10 aa, Artificial Sequence
  Description of Artificial Sequence: Synthetic peptide
  Seed: GAPRGPHGGA (CTG1B_HUMAN)
GHPRGPHGGM

SEQ ID NO: 33465 - protein, 10 aa, Artificial Sequence
  Description of Artificial Sequence: Synthetic peptide
  Seed: GAPRGPHGGA (CTG1B_HUMAN)
GMPRGPHGGM

SEQ ID NO: 33466 - protein, 9 aa, Artificial Sequence
  Description of Artificial Sequence: Synthetic peptide
  Seed: LAMPFATPM (CTG1B_HUMAN)
LMMPFATPT

SEQ ID NO: 33467 - protein, 9 aa, Artificial Sequence
  Description of Artificial Sequence: Synthetic peptide
  Seed: ITQCFLPVF (CTG1B_HUMAN)
IVQCFLPVY

SEQ ID NO: 33468 - protein, 11 aa, Artificial Sequence
  Description of Artificial Sequence: Synthetic peptide
  Seed: YLAMPFATPME (CTG1B_HUMAN)
YRAMPFATPMV

SEQ ID NO: 33469 - protein, 9 aa, Artificial Sequence
  Description of Artificial Sequence: Synthetic peptide
  Seed: AQDAPPLPV (CTG1B_HUMAN)
AADAPPLPV

SEQ ID NO: 33470 - protein, 9 aa, Artificial Sequence
  Description of Artificial Sequence: Synthetic peptide
  Seed: RLLEFYLAM (CTG1B_HUMAN)
RLLEFYLAL

SEQ ID NO: 33471 - protein, 10 aa, Artificial Sequence
  Description of Artificial Sequence: Synthetic peptide
  Seed: RLLEFYLAMP (CTG1B_HUMAN)
RILEFYLAMI

SEQ ID NO: 33472 - protein, 10 aa, Artificial Sequence
  Description of Artificial Sequence: Synthetic peptide
  Seed: GIPDGPGGNA (CTG1B_HUMAN)
GIPDGPGGNM

SEQ ID NO: 33473 - protein, 9 aa, Artificial Sequence
  Description of Artificial Sequence: Synthetic peptide
  Seed: LPVPGVLLK (CTG1B_HUMAN)
LSVPGVLLL

SEQ ID NO: 33474 - protein, 10 aa, Artificial Sequence
  Description of Artificial Sequence: Synthetic peptide
  Seed: FYLAMPFATP (CTG1B_HUMAN)
FDLAMPFATT

SEQ ID NO: 33475 - protein, 9 aa, Artificial Sequence
  Description of Artificial Sequence: Synthetic peptide
  Seed: TQCFLPVFL (CTG1B_HUMAN)
TMCFLPVFI

SEQ ID NO: 33476 - protein, 10 aa, Artificial Sequence
  Description of Artificial Sequence: Synthetic peptide
  Seed: FYLAMPFATP (CTG1B_HUMAN)
FMLAMPFATL

SEQ ID NO: 33477 - protein, 11 aa, Artificial Sequence
  Description of Artificial Sequence: Synthetic peptide
  Seed: RLLEFYLAMPF (CTG1B_HUMAN)
RGLEFYLAMPM

SEQ ID NO: 33478 - protein, 10 aa, Artificial Sequence
  Description of Artificial Sequence: Synthetic peptide
  Seed: LQQLSLLMWI (CTG1B_HUMAN)
LMQLSLLMWV

SEQ ID NO: 33479 - protein, 11 aa, Artificial Sequence
  Description of Artificial Sequence: Synthetic peptide
  Seed: RQLQLSISSCL (CTG1B_HUMAN)
RELQLSISSCF

SEQ ID NO: 33480 - protein, 9 aa, Artificial Sequence
  Description of Artificial Sequence: Synthetic peptide
  Seed: AADHRQLQL (CTG1B_HUMAN)
ALDHRQLQF

SEQ ID NO: 33481 - protein, 9 aa, Artificial Sequence
  Description of Artificial Sequence: Synthetic peptide
  Seed: FATPMEAEL (CTG1B_HUMAN)
FGTPMEAEW

SEQ ID NO: 33482 - protein, 9 aa, Artificial Sequence
  Description of Artificial Sequence: Synthetic peptide
  Seed: LLMWITQCF (CTG1B_HUMAN)
LMMWITQCY

SEQ ID NO: 33483 - protein, 10 aa, Artificial Sequence
  Description of Artificial Sequence: Synthetic peptide
  Seed: SRLLEFYLAM (CTG1B_HUMAN)
SMLLEFYLAF

SEQ ID NO: 33484 - protein, 9 aa, Artificial Sequence
  Description of Artificial Sequence: Synthetic peptide
  Seed: LQLSISSCL (CTG1B_HUMAN)
LALSISSCF

SEQ ID NO: 33485 - protein, 9 aa, Artificial Sequence
  Description of Artificial Sequence: Synthetic peptide
  Seed: QDAPPLPVP (CTG1B_HUMAN)
QEAPPLPVT

SEQ ID NO: 33486 - protein, 9 aa, Artificial Sequence
  Description of Artificial Sequence: Synthetic peptide
  Seed: TAADHRQLQ (CTG1B_HUMAN)
TIADHRQLY

SEQ ID NO: 33487 - protein, 9 aa, Artificial Sequence
  Description of Artificial Sequence: Synthetic peptide
  Seed: TPMEAELAR (CTG1B_HUMAN)
TLMEAELAK

SEQ ID NO: 33488 - protein, 9 aa, Artificial Sequence
  Description of Artificial Sequence: Synthetic peptide
  Seed: FATPMEAEL (CTG1B_HUMAN)
FCTPMEAEY

SEQ ID NO: 33489 - protein, 9 aa, Artificial Sequence
  Description of Artificial Sequence: Synthetic peptide
  Seed: LEFYLAMPF (CTG1B_HUMAN)
LEFYLAMPH

SEQ ID NO: 33490 - protein, 9 aa, Artificial Sequence
  Description of Artificial Sequence: Synthetic peptide
  Seed: LEFYLAMPF (CTG1B_HUMAN)
LLFYLAMPF

SEQ ID NO: 33491 - protein, 11 aa, Artificial Sequence
  Description of Artificial Sequence: Synthetic peptide
  Seed: RLLEFYLAMPF (CTG1B_HUMAN)
RELEFYLAMPL

SEQ ID NO: 33492 - protein, 10 aa, Artificial Sequence
  Description of Artificial Sequence: Synthetic peptide
  Seed: MPFATPMEAE (CTG1B_HUMAN)
MPFATPMEAD

SEQ ID NO: 33493 - protein, 9 aa, Artificial Sequence
  Description of Artificial Sequence: Synthetic peptide
  Seed: TQCFLPVFL (CTG1B_HUMAN)
TQCFLPVFF

SEQ ID NO: 33494 - protein, 9 aa, Artificial Sequence
  Description of Artificial Sequence: Synthetic peptide
  Seed: APPLPVPGV (CTG1B_HUMAN)
ACPLPVPGL

SEQ ID NO: 33495 - protein, 9 aa, Artificial Sequence
  Description of Artificial Sequence: Synthetic peptide
  Seed: FATPMEAEL (CTG1B_HUMAN)
FITPMEAEI

SEQ ID NO: 33496 - protein, 10 aa, Artificial Sequence
  Description of Artificial Sequence: Synthetic peptide
  Seed: LEFYLAMPFA (CTG1B_HUMAN)
LQFYLAMPFF

SEQ ID NO: 33497 - protein, 9 aa, Artificial Sequence
  Description of Artificial Sequence: Synthetic peptide
  Seed: KEFTVSGNI (CTG1B_HUMAN)
KEFTVSGNA

SEQ ID NO: 33498 - protein, 10 aa, Artificial Sequence
  Description of Artificial Sequence: Synthetic peptide
  Seed: LLEFYLAMPF (CTG1B_HUMAN)
LSEFYLAMPW

SEQ ID NO: 33499 - protein, 9 aa, Artificial Sequence
  Description of Artificial Sequence: Synthetic peptide
  Seed: LAMPFATPM (CTG1B_HUMAN)
LLMPFATPY

SEQ ID NO: 33500 - protein, 9 aa, Artificial Sequence
  Description of Artificial Sequence: Synthetic peptide
  Seed: GARGPESRL (CTG1B_HUMAN)
GQRGPESRF

SEQ ID NO: 33501 - protein, 10 aa, Artificial Sequence
  Description of Artificial Sequence: Synthetic peptide
  Seed: SRLLEFYLAM (CTG1B_HUMAN)
SQLLEFYLAI

SEQ ID NO: 33502 - protein, 10 aa, Artificial Sequence
  Description of Artificial Sequence: Synthetic peptide
  Seed: KEFTVSGNIL (CTG1B_HUMAN)
KMFTVSGNIY

SEQ ID NO: 33503 - protein, 10 aa, Artificial Sequence
  Description of Artificial Sequence: Synthetic peptide
  Seed: ITQCFLPVFL (CTG1B_HUMAN)
IMQCFLPVFL

SEQ ID NO: 33504 - protein, 11 aa, Artificial Sequence
  Description of Artificial Sequence: Synthetic peptide
  Seed: FYLAMPFATPM (CTG1B_HUMAN)
FLLAMPFATPI

SEQ ID NO: 33505 - protein, 9 aa, Artificial Sequence
  Description of Artificial Sequence: Synthetic peptide
  Seed: MQAEGRGTG (CTG1B_HUMAN)
MEAEGRGTF

SEQ ID NO: 33506 - protein, 9 aa, Artificial Sequence
  Description of Artificial Sequence: Synthetic peptide
  Seed: AQDAPPLPV (CTG1B_HUMAN)
ASDAPPLPV

SEQ ID NO: 33507 - protein, 10 aa, Artificial Sequence
  Description of Artificial Sequence: Synthetic peptide
  Seed: LAQDAPPLPV (CTG1B_HUMAN)
LMQDAPPLPV

SEQ ID NO: 33508 - protein, 11 aa, Artificial Sequence
  Description of Artificial Sequence: Synthetic peptide
  Seed: LPVPGVLLKEF (CTG1B_HUMAN)
LPVPGVLLKEW

SEQ ID NO: 33509 - protein, 10 aa, Artificial Sequence
  Description of Artificial Sequence: Synthetic peptide
  Seed: FYLAMPFATP (CTG1B_HUMAN)
FHLAMPFATT

SEQ ID NO: 33510 - protein, 11 aa, Artificial Sequence
  Description of Artificial Sequence: Synthetic peptide
  Seed: SLLMWITQCFL (CTG1B_HUMAN)
SMLMWITQCFL

SEQ ID NO: 33511 - protein, 11 aa, Artificial Sequence
  Description of Artificial Sequence: Synthetic peptide
  Seed: GAPRGPHGGAA (CTG1B_HUMAN)
GYPRGPHGGAI

SEQ ID NO: 33512 - protein, 10 aa, Artificial Sequence
  Description of Artificial Sequence: Synthetic peptide
  Seed: GAPRGPHGGA (CTG1B_HUMAN)
GSPRGPHGGL

SEQ ID NO: 33513 - protein, 9 aa, Artificial Sequence
  Description of Artificial Sequence: Synthetic peptide
  Seed: LEFYLAMPF (CTG1B_HUMAN)
LKFYLAMPV

SEQ ID NO: 33514 - protein, 10 aa, Artificial Sequence
  Description of Artificial Sequence: Synthetic peptide
  Seed: AMPFATPMEA (CTG1B_HUMAN)
AMPFATPMEM

SEQ ID NO: 33515 - protein, 10 aa, Artificial Sequence
  Description of Artificial Sequence: Synthetic peptide
  Seed: RGPHGGAASG (CTG1B_HUMAN)
RYPHGGAASA

SEQ ID NO: 33516 - protein, 11 aa, Artificial Sequence
  Description of Artificial Sequence: Synthetic peptide
  Seed: AARASGPGGGA (CTG1B_HUMAN)
APRASGPGGGI

SEQ ID NO: 33517 - protein, 9 aa, Artificial Sequence
  Description of Artificial Sequence: Synthetic peptide
  Seed: LEFYLAMPF (CTG1B_HUMAN)
LAFYLAMPW

SEQ ID NO: 33518 - protein, 10 aa, Artificial Sequence
  Description of Artificial Sequence: Synthetic peptide
  Seed: FTVSGNILTI (CTG1B_HUMAN)
FVVSGNILTM

SEQ ID NO: 33519 - protein, 9 aa, Artificial Sequence
  Description of Artificial Sequence: Synthetic peptide
  Seed: LTAADHRQL (CTG1B_HUMAN)
LAAADHRQL

SEQ ID NO: 33520 - protein, 11 aa, Artificial Sequence
  Description of Artificial Sequence: Synthetic peptide
  Seed: RLLEFYLAMPF (CTG1B_HUMAN)
RSLEFYLAMPL

SEQ ID NO: 33521 - protein, 10 aa, Artificial Sequence
  Description of Artificial Sequence: Synthetic peptide
  Seed: RGPHGGAASG (CTG1B_HUMAN)
RSPHGGAASF

SEQ ID NO: 33522 - protein, 10 aa, Artificial Sequence
  Description of Artificial Sequence: Synthetic peptide
  Seed: LAQDAPPLPV (CTG1B_HUMAN)
LAQDAPPLPL

SEQ ID NO: 33523 - protein, 10 aa, Artificial Sequence
  Description of Artificial Sequence: Synthetic peptide
  Seed: LEFYLAMPFA (CTG1B_HUMAN)
LQFYLAMPFM

SEQ ID NO: 33524 - protein, 9 aa, Artificial Sequence
  Description of Artificial Sequence: Synthetic peptide
  Seed: TQCFLPVFL (CTG1B_HUMAN)
THCFLPVFM

SEQ ID NO: 33525 - protein, 9 aa, Artificial Sequence
  Description of Artificial Sequence: Synthetic peptide
  Seed: QQLSLLMWI (CTG1B_HUMAN)
QMLSLLMWA

SEQ ID NO: 33526 - protein, 10 aa, Artificial Sequence
  Description of Artificial Sequence: Synthetic peptide
  Seed: SRLLEFYLAM (CTG1B_HUMAN)
SALLEFYLAY

SEQ ID NO: 33527 - protein, 9 aa, Artificial Sequence
  Description of Artificial Sequence: Synthetic peptide
  Seed: IPDGPGGNA (CTG1B_HUMAN)
ISDGPGGNV

SEQ ID NO: 33528 - protein, 10 aa, Artificial Sequence
  Description of Artificial Sequence: Synthetic peptide
  Seed: EFTVSGNILT (CTG1B_HUMAN)
ETTVSGNILV

SEQ ID NO: 33529 - protein, 10 aa, Artificial Sequence
  Description of Artificial Sequence: Synthetic peptide
  Seed: FLPVFLAQPP (CTG1B_HUMAN)
FDPVFLAQPA

SEQ ID NO: 33530 - protein, 10 aa, Artificial Sequence
  Description of Artificial Sequence: Synthetic peptide
  Seed: AMPFATPMEA (CTG1B_HUMAN)
ATPFATPMEY

SEQ ID NO: 33531 - protein, 11 aa, Artificial Sequence
  Description of Artificial Sequence: Synthetic peptide
  Seed: GDADGPGGPGI (CTG1B_HUMAN)
GEADGPGGPGA

SEQ ID NO: 33532 - protein, 11 aa, Artificial Sequence
  Description of Artificial Sequence: Synthetic peptide
  Seed: FYLAMPFATPM (CTG1B_HUMAN)
FDLAMPFATPL

SEQ ID NO: 33533 - protein, 10 aa, Artificial Sequence
  Description of Artificial Sequence: Synthetic peptide
  Seed: SLLMWITQCF (CTG1B_HUMAN)
SLLMWITQCY

SEQ ID NO: 33534 - protein, 9 aa, Artificial Sequence
  Description of Artificial Sequence: Synthetic peptide
  Seed: LAMPFATPM (CTG1B_HUMAN)
LIMPFATPK

SEQ ID NO: 33535 - protein, 10 aa, Artificial Sequence
  Description of Artificial Sequence: Synthetic peptide
  Seed: KEFTVSGNIL (CTG1B_HUMAN)
KQFTVSGNIL

SEQ ID NO: 33536 - protein, 9 aa, Artificial Sequence
  Description of Artificial Sequence: Synthetic peptide
  Seed: SGPGGGAPR (CTG1B_HUMAN)
STPGGGAPK

SEQ ID NO: 33537 - protein, 9 aa, Artificial Sequence
  Description of Artificial Sequence: Synthetic peptide
  Seed: LLKEFTVSG (CTG1B_HUMAN)
LLKEFTVSV

SEQ ID NO: 33538 - protein, 10 aa, Artificial Sequence
  Description of Artificial Sequence: Synthetic peptide
  Seed: ITQCFLPVFL (CTG1B_HUMAN)
IMQCFLPVFV

SEQ ID NO: 33539 - protein, 9 aa, Artificial Sequence
  Description of Artificial Sequence: Synthetic peptide
  Seed: SGPGGGAPR (CTG1B_HUMAN)
SAPGGGAPH

SEQ ID NO: 33540 - protein, 10 aa, Artificial Sequence
  Description of Artificial Sequence: Synthetic peptide
  Seed: DAPPLPVPGV (CTG1B_HUMAN)
DTPPLPVPGV

SEQ ID NO: 33541 - protein, 9 aa, Artificial Sequence
  Description of Artificial Sequence: Synthetic peptide
  Seed: SISSCLQQL (CTG1B_HUMAN)
SISSCLQQV

SEQ ID NO: 33542 - protein, 10 aa, Artificial Sequence
  Description of Artificial Sequence: Synthetic peptide
  Seed: QLQLSISSCL (CTG1B_HUMAN)
QLQLSISSCV

SEQ ID NO: 33543 - protein, 9 aa, Artificial Sequence
  Description of Artificial Sequence: Synthetic peptide
  Seed: AQDAPPLPV (CTG1B_HUMAN)
AIDAPPLPY

SEQ ID NO: 33544 - protein, 10 aa, Artificial Sequence
  Description of Artificial Sequence: Synthetic peptide
  Seed: RASGPGGGAP (CTG1B_HUMAN)
RVSGPGGGAM

SEQ ID NO: 33545 - protein, 9 aa, Artificial Sequence
  Description of Artificial Sequence: Synthetic peptide
  Seed: FLPVFLAQP (CTG1B_HUMAN)
FQPVFLAQL

SEQ ID NO: 33546 - protein, 9 aa, Artificial Sequence
  Description of Artificial Sequence: Synthetic peptide
  Seed: FTVSGNILT (CTG1B_HUMAN)
FIVSGNILI

SEQ ID NO: 33547 - protein, 9 aa, Artificial Sequence
  Description of Artificial Sequence: Synthetic peptide
  Seed: SCLQQLSLL (CTG1B_HUMAN)
SALQQLSLY

SEQ ID NO: 33548 - protein, 11 aa, Artificial Sequence
  Description of Artificial Sequence: Synthetic peptide
  Seed: MWITQCFLPVF (CTG1B_HUMAN)
MTITQCFLPVF

SEQ ID NO: 33549 - protein, 10 aa, Artificial Sequence
  Description of Artificial Sequence: Synthetic peptide
  Seed: LLMWITQCFL (CTG1B_HUMAN)
LIMWITQCFV

SEQ ID NO: 33550 - protein, 10 aa, Artificial Sequence
  Description of Artificial Sequence: Synthetic peptide
  Seed: FYLAMPFATP (CTG1B_HUMAN)
FKLAMPFATI

SEQ ID NO: 33551 - protein, 11 aa, Artificial Sequence
  Description of Artificial Sequence: Synthetic peptide
  Seed: RLLEFYLAMPF (CTG1B_HUMAN)
RKLEFYLAMPF

SEQ ID NO: 33552 - protein, 10 aa, Artificial Sequence
  Description of Artificial Sequence: Synthetic peptide
  Seed: RGPHGGAASG (CTG1B_HUMAN)
RWPHGGAASA

SEQ ID NO: 33553 - protein, 9 aa, Artificial Sequence
  Description of Artificial Sequence: Synthetic peptide
  Seed: RLLEFYLAM (CTG1B_HUMAN)
RLLEFYLAR

SEQ ID NO: 33554 - protein, 10 aa, Artificial Sequence
  Description of Artificial Sequence: Synthetic peptide
  Seed: SRLLEFYLAM (CTG1B_HUMAN)
SCLLEFYLAL

SEQ ID NO: 33555 - protein, 11 aa, Artificial Sequence
  Description of Artificial Sequence: Synthetic peptide
  Seed: FYLAMPFATPM (CTG1B_HUMAN)
FELAMPFATPV

SEQ ID NO: 33556 - protein, 11 aa, Artificial Sequence
  Description of Artificial Sequence: Synthetic peptide
  Seed: RLLEFYLAMPF (CTG1B_HUMAN)
RRLEFYLAMPI

SEQ ID NO: 33557 - protein, 9 aa, Artificial Sequence
  Description of Artificial Sequence: Synthetic peptide
  Seed: MEAELARRS (CTG1B_HUMAN)
MEAELARRM

SEQ ID NO: 33558 - protein, 9 aa, Artificial Sequence
  Description of Artificial Sequence: Synthetic peptide
  Seed: GVLLKEFTV (CTG1B_HUMAN)
GMLLKEFTL

SEQ ID NO: 33559 - protein, 9 aa, Artificial Sequence
  Description of Artificial Sequence: Synthetic peptide
  Seed: LLMWITQCF (CTG1B_HUMAN)
LVMWITQCF

SEQ ID NO: 33560 - protein, 9 aa, Artificial Sequence
  Description of Artificial Sequence: Synthetic peptide
  Seed: FATPMEAEL (CTG1B_HUMAN)
FGTPMEAEL

SEQ ID NO: 33561 - protein, 9 aa, Artificial Sequence
  Description of Artificial Sequence: Synthetic peptide
  Seed: LLKEFTVSG (CTG1B_HUMAN)
LMKEFTVSA

SEQ ID NO: 33562 - protein, 9 aa, Artificial Sequence
  Description of Artificial Sequence: Synthetic peptide
  Seed: SLLMWITQC (CTG1B_HUMAN)
SQLMWITQM

SEQ ID NO: 33563 - protein, 9 aa, Artificial Sequence
  Description of Artificial Sequence: Synthetic peptide
  Seed: MPFATPMEA (CTG1B_HUMAN)
MVFATPMEI

SEQ ID NO: 33564 - protein, 9 aa, Artificial Sequence
  Description of Artificial Sequence: Synthetic peptide
  Seed: GRGPRGAGA (CTG1B_HUMAN)
GRGPRGAGF

SEQ ID NO: 33565 - protein, 11 aa, Artificial Sequence
  Description of Artificial Sequence: Synthetic peptide
  Seed: LAMPFATPMEA (CTG1B_HUMAN)
LQMPFATPMEA

SEQ ID NO: 33566 - protein, 9 aa, Artificial Sequence
  Description of Artificial Sequence: Synthetic peptide
  Seed: ASGPGGGAP (CTG1B_HUMAN)
ATGPGGGAY

SEQ ID NO: 33567 - protein, 10 aa, Artificial Sequence
  Description of Artificial Sequence: Synthetic peptide
  Seed: YLAMPFATPM (CTG1B_HUMAN)
YTAMPFATPL

SEQ ID NO: 33568 - protein, 10 aa, Artificial Sequence
  Description of Artificial Sequence: Synthetic peptide
  Seed: FYLAMPFATP (CTG1B_HUMAN)
FVLAMPFATA

SEQ ID NO: 33569 - protein, 10 aa, Artificial Sequence
  Description of Artificial Sequence: Synthetic peptide
  Seed: APRGPHGGAA (CTG1B_HUMAN)
APRGPHGGAL

SEQ ID NO: 33570 - protein, 9 aa, Artificial Sequence
  Description of Artificial Sequence: Synthetic peptide
  Seed: ITQCFLPVF (CTG1B_HUMAN)
IIQCFLPVY

SEQ ID NO: 33571 - protein, 10 aa, Artificial Sequence
  Description of Artificial Sequence: Synthetic peptide
  Seed: YLAMPFATPM (CTG1B_HUMAN)
YPAMPFATPH

SEQ ID NO: 33572 - protein, 9 aa, Artificial Sequence
  Description of Artificial Sequence: Synthetic peptide
  Seed: RLLEFYLAM (CTG1B_HUMAN)
RTLEFYLAF

SEQ ID NO: 33573 - protein, 9 aa, Artificial Sequence
  Description of Artificial Sequence: Synthetic peptide
  Seed: AQDAPPLPV (CTG1B_HUMAN)
AMDAPPLPF

SEQ ID NO: 33574 - protein, 9 aa, Artificial Sequence
  Description of Artificial Sequence: Synthetic peptide
  Seed: LMWITQCFL (CTG1B_HUMAN)
LMWITQCFY

SEQ ID NO: 33575 - protein, 10 aa, Artificial Sequence
  Description of Artificial Sequence: Synthetic peptide
  Seed: FYLAMPFATP (CTG1B_HUMAN)
FWLAMPFATM

SEQ ID NO: 33576 - protein, 9 aa, Artificial Sequence
  Description of Artificial Sequence: Synthetic peptide
  Seed: TQCFLPVFL (CTG1B_HUMAN)
TICFLPVFV

SEQ ID NO: 33577 - protein, 10 aa, Artificial Sequence
  Description of Artificial Sequence: Synthetic peptide
  Seed: QQLSLLMWIT (CTG1B_HUMAN)
QQLSLLMWIL

SEQ ID NO: 33578 - protein, 11 aa, Artificial Sequence
  Description of Artificial Sequence: Synthetic peptide
  Seed: RLLEFYLAMPF (CTG1B_HUMAN)
RPLEFYLAMPM

SEQ ID NO: 33579 - protein, 10 aa, Artificial Sequence
  Description of Artificial Sequence: Synthetic peptide
  Seed: YLAMPFATPM (CTG1B_HUMAN)
YLAMPFATPW

SEQ ID NO: 33580 - protein, 10 aa, Artificial Sequence
  Description of Artificial Sequence: Synthetic peptide
  Seed: AMPFATPMEA (CTG1B_HUMAN)
ALPFATPMEI

SEQ ID NO: 33581 - protein, 9 aa, Artificial Sequence
  Description of Artificial Sequence: Synthetic peptide
  Seed: AQDAPPLPV (CTG1B_HUMAN)
AGDAPPLPF

SEQ ID NO: 33582 - protein, 9 aa, Artificial Sequence
  Description of Artificial Sequence: Synthetic peptide
  Seed: IPDGPGGNA (CTG1B_HUMAN)
IMDGPGGNI

SEQ ID NO: 33583 - protein, 10 aa, Artificial Sequence
  Description of Artificial Sequence: Synthetic peptide
  Seed: SRLLEFYLAM (CTG1B_HUMAN)
SMLLEFYLAV

SEQ ID NO: 33584 - protein, 9 aa, Artificial Sequence
  Description of Artificial Sequence: Synthetic peptide
  Seed: LAMPFATPM (CTG1B_HUMAN)
LKMPFATPY

SEQ ID NO: 33585 - protein, 10 aa, Artificial Sequence
  Description of Artificial Sequence: Synthetic peptide
  Seed: EFTVSGNILT (CTG1B_HUMAN)
ENTVSGNILI

SEQ ID NO: 33586 - protein, 9 aa, Artificial Sequence
  Description of Artificial Sequence: Synthetic peptide
  Seed: AADHRQLQL (CTG1B_HUMAN)
AWDHRQLQV

SEQ ID NO: 33587 - protein, 11 aa, Artificial Sequence
  Description of Artificial Sequence: Synthetic peptide
  Seed: RLLEFYLAMPF (CTG1B_HUMAN)
RILEFYLAMPW

SEQ ID NO: 33588 - protein, 10 aa, Artificial Sequence
  Description of Artificial Sequence: Synthetic peptide
  Seed: TAADHRQLQL (CTG1B_HUMAN)
TVADHRQLQW

SEQ ID NO: 33589 - protein, 9 aa, Artificial Sequence
  Description of Artificial Sequence: Synthetic peptide
  Seed: MPFATPMEA (CTG1B_HUMAN)
MSFATPMEI

SEQ ID NO: 33590 - protein, 10 aa, Artificial Sequence
  Description of Artificial Sequence: Synthetic peptide
  Seed: TVSGNILTIR (CTG1B_HUMAN)
TVSGNILTIK

SEQ ID NO: 33591 - protein, 10 aa, Artificial Sequence
  Description of Artificial Sequence: Synthetic peptide
  Seed: ITQCFLPVFL (CTG1B_HUMAN)
ILQCFLPVFV

SEQ ID NO: 33592 - protein, 10 aa, Artificial Sequence
  Description of Artificial Sequence: Synthetic peptide
  Seed: RGPESRLLEF (CTG1B_HUMAN)
RQPESRLLEM

SEQ ID NO: 33593 - protein, 9 aa, Artificial Sequence
  Description of Artificial Sequence: Synthetic peptide
  Seed: SLAQDAPPL (CTG1B_HUMAN)
SVAQDAPPV

SEQ ID NO: 33594 - protein, 10 aa, Artificial Sequence
  Description of Artificial Sequence: Synthetic peptide
  Seed: YLAMPFATPM (CTG1B_HUMAN)
YMAMPFATPA

SEQ ID NO: 33595 - protein, 10 aa, Artificial Sequence
  Description of Artificial Sequence: Synthetic peptide
  Seed: YLAMPFATPM (CTG1B_HUMAN)
YVAMPFATPW

SEQ ID NO: 33596 - protein, 10 aa, Artificial Sequence
  Description of Artificial Sequence: Synthetic peptide
  Seed: SRLLEFYLAM (CTG1B_HUMAN)
SRLLEFYLAK

SEQ ID NO: 33597 - protein, 10 aa, Artificial Sequence
  Description of Artificial Sequence: Synthetic peptide
  Seed: FYLAMPFATP (CTG1B_HUMAN)
FWLAMPFATA

SEQ ID NO: 33598 - protein, 10 aa, Artificial Sequence
  Description of Artificial Sequence: Synthetic peptide
  Seed: RQLQLSISSC (CTG1B_HUMAN)
RELQLSISSV

SEQ ID NO: 33599 - protein, 10 aa, Artificial Sequence
  Description of Artificial Sequence: Synthetic peptide
  Seed: TVSGNILTIR (CTG1B_HUMAN)
TASGNILTIY

SEQ ID NO: 33600 - protein, 10 aa, Artificial Sequence
  Description of Artificial Sequence: Synthetic peptide
  Seed: FLPVFLAQPP (CTG1B_HUMAN)
FLPVFLAQPA

SEQ ID NO: 33601 - protein, 9 aa, Artificial Sequence
  Description of Artificial Sequence: Synthetic peptide
  Seed: LEFYLAMPF (CTG1B_HUMAN)
LHFYLAMPL

SEQ ID NO: 33602 - protein, 10 aa, Artificial Sequence
  Description of Artificial Sequence: Synthetic peptide
  Seed: RLLEFYLAMP (CTG1B_HUMAN)
RRLEFYLAMV

SEQ ID NO: 33603 - protein, 9 aa, Artificial Sequence
  Description of Artificial Sequence: Synthetic peptide
  Seed: SLLMWITQC (CTG1B_HUMAN)
SVLMWITQI

SEQ ID NO: 33604 - protein, 10 aa, Artificial Sequence
  Description of Artificial Sequence: Synthetic peptide
  Seed: MEAELARRSL (CTG1B_HUMAN)
MPAELARRSV

SEQ ID NO: 33605 - protein, 10 aa, Artificial Sequence
  Description of Artificial Sequence: Synthetic peptide
  Seed: SRLLEFYLAM (CTG1B_HUMAN)
SWLLEFYLAA

SEQ ID NO: 33606 - protein, 9 aa, Artificial Sequence
  Description of Artificial Sequence: Synthetic peptide
  Seed: RLLEFYLAM (CTG1B_HUMAN)
RKLEFYLAW

SEQ ID NO: 33607 - protein, 11 aa, Artificial Sequence
  Description of Artificial Sequence: Synthetic peptide
  Seed: MPFATPMEAEL (CTG1B_HUMAN)
MAFATPMEAEY

SEQ ID NO: 33608 - protein, 8 aa, Artificial Sequence
  Description of Artificial Sequence: Synthetic peptide
  Seed: FTVSGNIL (CTG1B_HUMAN)
FSVSGNIY

SEQ ID NO: 33609 - protein, 11 aa, Artificial Sequence
  Description of Artificial Sequence: Synthetic peptide
  Seed: APRGPHGGAAS (CTG1B_HUMAN)
APRGPHGGAAM

SEQ ID NO: 33610 - protein, 9 aa, Artificial Sequence
  Description of Artificial Sequence: Synthetic peptide
  Seed: LMWITQCFL (CTG1B_HUMAN)
LIWITQCFV

SEQ ID NO: 33611 - protein, 11 aa, Artificial Sequence
  Description of Artificial Sequence: Synthetic peptide
  Seed: FYLAMPFATPM (CTG1B_HUMAN)
FTLAMPFATPY

SEQ ID NO: 33612 - protein, 9 aa, Artificial Sequence
  Description of Artificial Sequence: Synthetic peptide
  Seed: RLLEFYLAM (CTG1B_HUMAN)
RTLEFYLAV

SEQ ID NO: 33613 - protein, 10 aa, Artificial Sequence
  Description of Artificial Sequence: Synthetic peptide
  Seed: GAPRGPHGGA (CTG1B_HUMAN)
GWPRGPHGGL

SEQ ID NO: 33614 - protein, 9 aa, Artificial Sequence
  Description of Artificial Sequence: Synthetic peptide
  Seed: MPFATPMEA (CTG1B_HUMAN)
MIFATPMEF

SEQ ID NO: 33615 - protein, 9 aa, Artificial Sequence
  Description of Artificial Sequence: Synthetic peptide
  Seed: SISSCLQQL (CTG1B_HUMAN)
SLSSCLQQW

SEQ ID NO: 33616 - protein, 10 aa, Artificial Sequence
  Description of Artificial Sequence: Synthetic peptide
  Seed: AMPFATPMEA (CTG1B_HUMAN)
ALPFATPMEM

SEQ ID NO: 33617 - protein, 9 aa, Artificial Sequence
  Description of Artificial Sequence: Synthetic peptide
  Seed: QQLSLLMWI (CTG1B_HUMAN)
QMLSLLMWI

SEQ ID NO: 33618 - protein, 10 aa, Artificial Sequence
  Description of Artificial Sequence: Synthetic peptide
  Seed: RGPHGGAASG (CTG1B_HUMAN)
RKPHGGAASF

SEQ ID NO: 33619 - protein, 10 aa, Artificial Sequence
  Description of Artificial Sequence: Synthetic peptide
  Seed: RLTAADHRQL (CTG1B_HUMAN)
RETAADHRQF

SEQ ID NO: 33620 - protein, 10 aa, Artificial Sequence
  Description of Artificial Sequence: Synthetic peptide
  Seed: RLLEFYLAMP (CTG1B_HUMAN)
RLLEFYLAMI

SEQ ID NO: 33621 - protein, 9 aa, Artificial Sequence
  Description of Artificial Sequence: Synthetic peptide
  Seed: RLLEFYLAM (CTG1B_HUMAN)
RVLEFYLAV

SEQ ID NO: 33622 - protein, 11 aa, Artificial Sequence
  Description of Artificial Sequence: Synthetic peptide
  Seed: RLLEFYLAMPF (CTG1B_HUMAN)
RMLEFYLAMPY

SEQ ID NO: 33623 - protein, 11 aa, Artificial Sequence
  Description of Artificial Sequence: Synthetic peptide
  Seed: RLLEFYLAMPF (CTG1B_HUMAN)
RELEFYLAMPV

SEQ ID NO: 33624 - protein, 10 aa, Artificial Sequence
  Description of Artificial Sequence: Synthetic peptide
  Seed: AMPFATPMEA (CTG1B_HUMAN)
ACPFATPMEY

SEQ ID NO: 33625 - protein, 9 aa, Artificial Sequence
  Description of Artificial Sequence: Synthetic peptide
  Seed: SLLMWITQC (CTG1B_HUMAN)
SALMWITQV

SEQ ID NO: 33626 - protein, 8 aa, Artificial Sequence
  Description of Artificial Sequence: Synthetic peptide
  Seed: AMPFATPM (CTG1B_HUMAN)
AQPFATPF

SEQ ID NO: 33627 - protein, 9 aa, Artificial Sequence
  Description of Artificial Sequence: Synthetic peptide
  Seed: SISSCLQQL (CTG1B_HUMAN)
SQSSCLQQV

SEQ ID NO: 33628 - protein, 10 aa, Artificial Sequence
  Description of Artificial Sequence: Synthetic peptide
  Seed: YLAMPFATPM (CTG1B_HUMAN)
YHAMPFATPL

SEQ ID NO: 33629 - protein, 10 aa, Artificial Sequence
  Description of Artificial Sequence: Synthetic peptide
  Seed: YLAMPFATPM (CTG1B_HUMAN)
YLAMPFATPV

SEQ ID NO: 33630 - protein, 8 aa, Artificial Sequence
  Description of Artificial Sequence: Synthetic peptide
  Seed: ADHRQLQL (CTG1B_HUMAN)
AEHRQLQA

SEQ ID NO: 33631 - protein, 10 aa, Artificial Sequence
  Description of Artificial Sequence: Synthetic peptide
  Seed: FYLAMPFATP (CTG1B_HUMAN)
FRLAMPFATL

SEQ ID NO: 33632 - protein, 10 aa, Artificial Sequence
  Description of Artificial Sequence: Synthetic peptide
  Seed: YLAMPFATPM (CTG1B_HUMAN)
YNAMPFATPM

SEQ ID NO: 33633 - protein, 9 aa, Artificial Sequence
  Description of Artificial Sequence: Synthetic peptide
  Seed: ASGPGGGAP (CTG1B_HUMAN)
ASGPGGGAY

SEQ ID NO: 33634 - protein, 9 aa, Artificial Sequence
  Description of Artificial Sequence: Synthetic peptide
  Seed: SISSCLQQL (CTG1B_HUMAN)
SASSCLQQF

SEQ ID NO: 33635 - protein, 9 aa, Artificial Sequence
  Description of Artificial Sequence: Synthetic peptide
  Seed: SLLMWITQC (CTG1B_HUMAN)
SMLMWITQI

SEQ ID NO: 33636 - protein, 10 aa, Artificial Sequence
  Description of Artificial Sequence: Synthetic peptide
  Seed: GIPDGPGGNA (CTG1B_HUMAN)
GCPDGPGGNL

SEQ ID NO: 33637 - protein, 9 aa, Artificial Sequence
  Description of Artificial Sequence: Synthetic peptide
  Seed: MPFATPMEA (CTG1B_HUMAN)
MTFATPMEW

SEQ ID NO: 33638 - protein, 11 aa, Artificial Sequence
  Description of Artificial Sequence: Synthetic peptide
  Seed: FLAQPPSGQRR (CTG1B_HUMAN)
FVAQPPSGQRR

SEQ ID NO: 33639 - protein, 9 aa, Artificial Sequence
  Description of Artificial Sequence: Synthetic peptide
  Seed: LLMWITQCF (CTG1B_HUMAN)
LSMWITQCV

SEQ ID NO: 33640 - protein, 10 aa, Artificial Sequence
  Description of Artificial Sequence: Synthetic peptide
  Seed: KEFTVSGNIL (CTG1B_HUMAN)
KQFTVSGNIW

SEQ ID NO: 33641 - protein, 9 aa, Artificial Sequence
  Description of Artificial Sequence: Synthetic peptide
  Seed: ILTIRLTAA (CTG1B_HUMAN)
ILTIRLTAL

SEQ ID NO: 33642 - protein, 9 aa, Artificial Sequence
  Description of Artificial Sequence: Synthetic peptide
  Seed: MPFATPMEA (CTG1B_HUMAN)
MKFATPMEA

SEQ ID NO: 33643 - protein, 9 aa, Artificial Sequence
  Description of Artificial Sequence: Synthetic peptide
  Seed: RQLQLSISS (CTG1B_HUMAN)
RALQLSISY

SEQ ID NO: 33644 - protein, 9 aa, Artificial Sequence
  Description of Artificial Sequence: Synthetic peptide
  Seed: LAMPFATPM (CTG1B_HUMAN)
LFMPFATPM

SEQ ID NO: 33645 - protein, 9 aa, Artificial Sequence
  Description of Artificial Sequence: Synthetic peptide
  Seed: LAMPFATPM (CTG1B_HUMAN)
LRMPFATPV

SEQ ID NO: 33646 - protein, 9 aa, Artificial Sequence
  Description of Artificial Sequence: Synthetic peptide
  Seed: MPFATPMEA (CTG1B_HUMAN)
MAFATPMEM

SEQ ID NO: 33647 - protein, 10 aa, Artificial Sequence
  Description of Artificial Sequence: Synthetic peptide
  Seed: SLLMWITQCF (CTG1B_HUMAN)
SSLMWITQCY

SEQ ID NO: 33648 - protein, 10 aa, Artificial Sequence
  Description of Artificial Sequence: Synthetic peptide
  Seed: FLPVFLAQPP (CTG1B_HUMAN)
FFPVFLAQPV

SEQ ID NO: 33649 - protein, 11 aa, Artificial Sequence
  Description of Artificial Sequence: Synthetic peptide
  Seed: FYLAMPFATPM (CTG1B_HUMAN)
FWLAMPFATPM

SEQ ID NO: 33650 - protein, 9 aa, Artificial Sequence
  Description of Artificial Sequence: Synthetic peptide
  Seed: LEFYLAMPF (CTG1B_HUMAN)
LKFYLAMPW

SEQ ID NO: 33651 - protein, 9 aa, Artificial Sequence
  Description of Artificial Sequence: Synthetic peptide
  Seed: YLAMPFATP (CTG1B_HUMAN)
YQAMPFATL

SEQ ID NO: 33652 - protein, 10 aa, Artificial Sequence
  Description of Artificial Sequence: Synthetic peptide
  Seed: LPVFLAQPPS (CTG1B_HUMAN)
LPVFLAQPPA

SEQ ID NO: 33653 - protein, 10 aa, Artificial Sequence
  Description of Artificial Sequence: Synthetic peptide
  Seed: YLAMPFATPM (CTG1B_HUMAN)
YQAMPFATPH

SEQ ID NO: 33654 - protein, 10 aa, Artificial Sequence
  Description of Artificial Sequence: Synthetic peptide
  Seed: ASGPGGGAPR (CTG1B_HUMAN)
AVGPGGGAPK

SEQ ID NO: 33655 - protein, 9 aa, Artificial Sequence
  Description of Artificial Sequence: Synthetic peptide
  Seed: SLLMWITQC (CTG1B_HUMAN)
SILMWITQM

SEQ ID NO: 33656 - protein, 9 aa, Artificial Sequence
  Description of Artificial Sequence: Synthetic peptide
  Seed: FTVSGNILT (CTG1B_HUMAN)
FMVSGNILA

SEQ ID NO: 33657 - protein, 9 aa, Artificial Sequence
  Description of Artificial Sequence: Synthetic peptide
  Seed: LPVPGVLLK (CTG1B_HUMAN)
LPVPGVLLM

SEQ ID NO: 33658 - protein, 10 aa, Artificial Sequence
  Description of Artificial Sequence: Synthetic peptide
  Seed: RGPESRLLEF (CTG1B_HUMAN)
RMPESRLLEM

SEQ ID NO: 33659 - protein, 9 aa, Artificial Sequence
  Description of Artificial Sequence: Synthetic peptide
  Seed: SISSCLQQL (CTG1B_HUMAN)
SSSSCLQQI

SEQ ID NO: 33660 - protein, 10 aa, Artificial Sequence
  Description of Artificial Sequence: Synthetic peptide
  Seed: SRLLEFYLAM (CTG1B_HUMAN)
SDLLEFYLAM

SEQ ID NO: 33661 - protein, 11 aa, Homo sapiens
  Native (CTG1B_HUMAN)
HRQLQLSISSC

SEQ ID NO: 33662 - protein, 11 aa, Homo sapiens
  Native (CTG1B_HUMAN)
CRCGARGPESR

SEQ ID NO: 33663 - protein, 11 aa, Homo sapiens
  Native (CTG1B_HUMAN)
SCLQQLSLLMW

SEQ ID NO: 33664 - protein, 8 aa, Homo sapiens
  Native (CTG1B_HUMAN)
TQCFLPVF

SEQ ID NO: 33665 - protein, 11 aa, Homo sapiens
  Native (CTG1B_HUMAN)
IRLTAADHRQL

SEQ ID NO: 33666 - protein, 11 aa, Homo sapiens
  Native (CTG1B_HUMAN)
ASGPGGGAPRG

SEQ ID NO: 33667 - protein, 9 aa, Homo sapiens
  Native (CTG1B_HUMAN)
NGCCRCGAR

SEQ ID NO: 33668 - protein, 9 aa, Homo sapiens
  Native (CTG1B_HUMAN)
RQLQLSISS

SEQ ID NO: 33669 - protein, 9 aa, Homo sapiens
  Native (CTG1B_HUMAN)
DHRQLQLSI

SEQ ID NO: 33670 - protein, 9 aa, Homo sapiens
  Native (CTG1B_HUMAN)
GGNAGGPGE

SEQ ID NO: 33671 - protein, 11 aa, Homo sapiens
  Native (CTG1B_HUMAN)
LLKEFTVSGNI

SEQ ID NO: 33672 - protein, 10 aa, Homo sapiens
  Native (CTG1B_HUMAN)
SGPGGGAPRG

SEQ ID NO: 33673 - protein, 11 aa, Homo sapiens
  Native (CTG1B_HUMAN)
LLMWITQCFLP

SEQ ID NO: 33674 - protein, 11 aa, Homo sapiens
  Native (CTG1B_HUMAN)
LTAADHRQLQL

SEQ ID NO: 33675 - protein, 10 aa, Homo sapiens
  Native (CTG1B_HUMAN)
RSLAQDAPPL

SEQ ID NO: 33676 - protein, 11 aa, Homo sapiens
  Native (CTG1B_HUMAN)
DAPPLPVPGVL

SEQ ID NO: 33677 - protein, 11 aa, Homo sapiens
  Native (CTG1B_HUMAN)
IPDGPGGNAGG

SEQ ID NO: 33678 - protein, 8 aa, Homo sapiens
  Native (CTG1B_HUMAN)
SRLLEFYL

SEQ ID NO: 33679 - protein, 10 aa, Homo sapiens
  Native (CTG1B_HUMAN)
GPGGPGIPDG

SEQ ID NO: 33680 - protein, 9 aa, Homo sapiens
  Native (CTG1B_HUMAN)
IPDGPGGNA

SEQ ID NO: 33681 - protein, 11 aa, Homo sapiens
  Native (CTG1B_HUMAN)
LLEFYLAMPFA

SEQ ID NO: 33682 - protein, 10 aa, Homo sapiens
  Native (CTG1B_HUMAN)
EFTVSGNILT

SEQ ID NO: 33683 - protein, 9 aa, Homo sapiens
  Native (CTG1B_HUMAN)
RRSLAQDAP

SEQ ID NO: 33684 - protein, 9 aa, Homo sapiens
  Native (CTG1B_HUMAN)
SLLMWITQC

SEQ ID NO: 33685 - protein, 10 aa, Homo sapiens
  Native (CTG1B_HUMAN)
SLLMWITQCF

SEQ ID NO: 33686 - protein, 9 aa, Homo sapiens
  Native (CTG1B_HUMAN)
SCLQQLSLL

SEQ ID NO: 33687 - protein, 10 aa, Homo sapiens
  Native (CTG1B_HUMAN)
LMWITQCFLP

SEQ ID NO: 33688 - protein, 8 aa, Homo sapiens
  Native (CTG1B_HUMAN)
MPFATPME

SEQ ID NO: 33689 - protein, 10 aa, Homo sapiens
  Native (CTG1B_HUMAN)
QLQLSISSCL

SEQ ID NO: 33690 - protein, 11 aa, Homo sapiens
  Native (CTG1B_HUMAN)
AADHRQLQLSI

SEQ ID NO: 33691 - protein, 11 aa, Homo sapiens
  Native (CTG1B_HUMAN)
GAPRGPHGGAA

SEQ ID NO: 33692 - protein, 10 aa, Homo sapiens
  Native (CTG1B_HUMAN)
SLAQDAPPLP

SEQ ID NO: 33693 - protein, 8 aa, Homo sapiens
  Native (CTG1B_HUMAN)
AELARRSL

SEQ ID NO: 33694 - protein, 10 aa, Homo sapiens
  Native (CTG1B_HUMAN)
FYLAMPFATP

SEQ ID NO: 33695 - protein, 9 aa, Homo sapiens
  Native (CTG1B_HUMAN)
GEAGATGGR

SEQ ID NO: 33696 - protein, 10 aa, Homo sapiens
  Native (CTG1B_HUMAN)
AMPFATPMEA

SEQ ID NO: 33697 - protein, 10 aa, Homo sapiens
  Native (CTG1B_HUMAN)
LEFYLAMPFA

SEQ ID NO: 33698 - protein, 10 aa, Homo sapiens
  Native (CTG1B_HUMAN)
PPLPVPGVLL

SEQ ID NO: 33699 - protein, 8 aa, Homo sapiens
  Native (CTG1B_HUMAN)
LQQLSLLM

SEQ ID NO: 33700 - protein, 10 aa, Homo sapiens
  Native (CTG1B_HUMAN)
LPVFLAQPPS

SEQ ID NO: 33701 - protein, 8 aa, Homo sapiens
  Native (CTG1B_HUMAN)
TAADHRQL

SEQ ID NO: 33702 - protein, 10 aa, Homo sapiens
  Native (CTG1B_HUMAN)
WITQCFLPVF

SEQ ID NO: 33703 - protein, 10 aa, Homo sapiens
  Native (CTG1B_HUMAN)
TAADHRQLQL

SEQ ID NO: 33704 - protein, 10 aa, Homo sapiens
  Native (CTG1B_HUMAN)
AASGLNGCCR

SEQ ID NO: 33705 - protein, 10 aa, Homo sapiens
  Native (CTG1B_HUMAN)
RLLEFYLAMP

SEQ ID NO: 33706 - protein, 9 aa, Homo sapiens
  Native (CTG1B_HUMAN)
TPMEAELAR

SEQ ID NO: 33707 - protein, 11 aa, Homo sapiens
  Native (CTG1B_HUMAN)
VFLAQPPSGQR

SEQ ID NO: 33708 - protein, 8 aa, Homo sapiens
  Native (CTG1B_HUMAN)
AMPFATPM

SEQ ID NO: 33709 - protein, 8 aa, Homo sapiens
  Native (CTG1B_HUMAN)
LPVPGVLL

SEQ ID NO: 33710 - protein, 11 aa, Homo sapiens
  Native (CTG1B_HUMAN)
FYLAMPFATPM

SEQ ID NO: 33711 - protein, 9 aa, Homo sapiens
  Native (CTG1B_HUMAN)
ASGPGGGAP

SEQ ID NO: 33712 - protein, 10 aa, Homo sapiens
  Native (CTG1B_HUMAN)
GIPDGPGGNA

SEQ ID NO: 33713 - protein, 9 aa, Homo sapiens
  Native (CTG1B_HUMAN)
SGPGGGAPR

SEQ ID NO: 33714 - protein, 11 aa, Homo sapiens
  Native (CTG1B_HUMAN)
GDADGPGGPGI

SEQ ID NO: 33715 - protein, 10 aa, Homo sapiens
  Native (CTG1B_HUMAN)
RLTAADHRQL

SEQ ID NO: 33716 - protein, 10 aa, Homo sapiens
  Native (CTG1B_HUMAN)
DAPPLPVPGV

SEQ ID NO: 33717 - protein, 11 aa, Homo sapiens
  Native (CTG1B_HUMAN)
FATPMEAELAR

SEQ ID NO: 33718 - protein, 9 aa, Homo sapiens
  Native (CTG1B_HUMAN)
TVSGNILTI

SEQ ID NO: 33719 - protein, 9 aa, Homo sapiens
  Native (CTG1B_HUMAN)
SGNILTIRL

SEQ ID NO: 33720 - protein, 11 aa, Homo sapiens
  Native (CTG1B_HUMAN)
LMWITQCFLPV

SEQ ID NO: 33721 - protein, 8 aa, Homo sapiens
  Native (CTG1B_HUMAN)
HRQLQLSI

SEQ ID NO: 33722 - protein, 11 aa, Homo sapiens
  Native (CTG1B_HUMAN)
RLLEFYLAMPF

SEQ ID NO: 33723 - protein, 9 aa, Homo sapiens
  Native (CTG1B_HUMAN)
CGARGPESR

SEQ ID NO: 33724 - protein, 10 aa, Homo sapiens
  Native (CTG1B_HUMAN)
GPGGGAPRGP

SEQ ID NO: 33725 - protein, 10 aa, Homo sapiens
  Native (CTG1B_HUMAN)
GPGGNAGGPG

SEQ ID NO: 33726 - protein, 10 aa, Homo sapiens
  Native (CTG1B_HUMAN)
HGGAASGLNG

SEQ ID NO: 33727 - protein, 11 aa, Homo sapiens
  Native (CTG1B_HUMAN)
PGGNAGGPGEA

SEQ ID NO: 33728 - protein, 9 aa, Homo sapiens
  Native (CTG1B_HUMAN)
GPRGAGAAR

SEQ ID NO: 33729 - protein, 11 aa, Homo sapiens
  Native (CTG1B_HUMAN)
LTIRLTAADHR

SEQ ID NO: 33730 - protein, 11 aa, Homo sapiens
  Native (CTG1B_HUMAN)
ARASGPGGGAP

SEQ ID NO: 33731 - protein, 11 aa, Homo sapiens
  Native (CTG1B_HUMAN)
RGPHGGAASGL

SEQ ID NO: 33732 - protein, 9 aa, Homo sapiens
  Native (CTG1B_HUMAN)
YLAMPFATP

SEQ ID NO: 33733 - protein, 11 aa, Homo sapiens
  Native (CTG1B_HUMAN)
APRGPHGGAAS

SEQ ID NO: 33734 - protein, 8 aa, Homo sapiens
  Native (CTG1B_HUMAN)
ARGPESRL

SEQ ID NO: 33735 - protein, 9 aa, Homo sapiens
  Native (CTG1B_HUMAN)
PRGPHGGAA

SEQ ID NO: 33736 - protein, 10 aa, Homo sapiens
  Native (CTG1B_HUMAN)
RGPESRLLEF

SEQ ID NO: 33737 - protein, 11 aa, Homo sapiens
  Native (CTG1B_HUMAN)
QDAPPLPVPGV

SEQ ID NO: 33738 - protein, 10 aa, Homo sapiens
  Native (CTG1B_HUMAN)
AGATGGRGPR

SEQ ID NO: 33739 - protein, 11 aa, Homo sapiens
  Native (CTG1B_HUMAN)
NAGGPGEAGAT

SEQ ID NO: 33740 - protein, 10 aa, Homo sapiens
  Native (CTG1B_HUMAN)
SSCLQQLSLL

SEQ ID NO: 33741 - protein, 9 aa, Homo sapiens
  Native (CTG1B_HUMAN)
GARGPESRL

SEQ ID NO: 33742 - protein, 10 aa, Homo sapiens
  Native (CTG1B_HUMAN)
LSISSCLQQL

SEQ ID NO: 33743 - protein, 10 aa, Homo sapiens
  Native (CTG1B_HUMAN)
RGPHGGAASG

SEQ ID NO: 33744 - protein, 9 aa, Homo sapiens
  Native (CTG1B_HUMAN)
VSGNILTIR

SEQ ID NO: 33745 - protein, 10 aa, Homo sapiens
  Native (CTG1B_HUMAN)
RASGPGGGAP

SEQ ID NO: 33746 - protein, 10 aa, Homo sapiens
  Native (CTG1B_HUMAN)
LAQDAPPLPV

SEQ ID NO: 33747 - protein, 9 aa, Homo sapiens
  Native (CTG1B_HUMAN)
APPLPVPGV

SEQ ID NO: 33748 - protein, 11 aa, Homo sapiens
  Native (CTG1B_HUMAN)
STGDADGPGGP

SEQ ID NO: 33749 - protein, 8 aa, Homo sapiens
  Native (CTG1B_HUMAN)
APPLPVPG

SEQ ID NO: 33750 - protein, 11 aa, Homo sapiens
  Native (CTG1B_HUMAN)
AGGPGEAGATG

SEQ ID NO: 33751 - protein, 9 aa, Homo sapiens
  Native (CTG1B_HUMAN)
LPVFLAQPP

SEQ ID NO: 33752 - protein, 9 aa, Homo sapiens
  Native (CTG1B_HUMAN)
ARGPESRLL

SEQ ID NO: 33753 - protein, 11 aa, Homo sapiens
  Native (CTG1B_HUMAN)
AEGRGTGGSTG

SEQ ID NO: 33754 - protein, 11 aa, Homo sapiens
  Native (CTG1B_HUMAN)
GGPGIPDGPGG

SEQ ID NO: 33755 - protein, 11 aa, Homo sapiens
  Native (CTG1B_HUMAN)
YLAMPFATPME

SEQ ID NO: 33756 - protein, 8 aa, Homo sapiens
  Native (CTG1B_HUMAN)
LAQDAPPL

SEQ ID NO: 33757 - protein, 10 aa, Homo sapiens
  Native (CTG1B_HUMAN)
ITQCFLPVFL

SEQ ID NO: 33758 - protein, 8 aa, Homo sapiens
  Native (CTG1B_HUMAN)
PLPVPGVL

SEQ ID NO: 33759 - protein, 10 aa, Homo sapiens
  Native (CTG1B_HUMAN)
LLEFYLAMPF

SEQ ID NO: 33760 - protein, 11 aa, Homo sapiens
  Native (CTG1B_HUMAN)
GGSTGDADGPG

SEQ ID NO: 33761 - protein, 9 aa, Homo sapiens
  Native (CTG1B_HUMAN)
LLKEFTVSG

SEQ ID NO: 33762 - protein, 9 aa, Homo sapiens
  Native (CTG1B_HUMAN)
GPESRLLEF

SEQ ID NO: 33763 - protein, 9 aa, Homo sapiens
  Native (CTG1B_HUMAN)
GPGEAGATG

SEQ ID NO: 33764 - protein, 10 aa, Homo sapiens
  Native (CTG1B_HUMAN)
AEGRGTGGST

SEQ ID NO: 33765 - protein, 10 aa, Homo sapiens
  Native (CTG1B_HUMAN)
ISSCLQQLSL

SEQ ID NO: 33766 - protein, 11 aa, Homo sapiens
  Native (CTG1B_HUMAN)
RRSLAQDAPPL

SEQ ID NO: 33767 - protein, 9 aa, Homo sapiens
  Native (CTG1B_HUMAN)
PESRLLEFY

SEQ ID NO: 33768 - protein, 9 aa, Homo sapiens
  Native (CTG1B_HUMAN)
PPLPVPGVL

SEQ ID NO: 33769 - protein, 11 aa, Homo sapiens
  Native (CTG1B_HUMAN)
RQLQLSISSCL

SEQ ID NO: 33770 - protein, 11 aa, Homo sapiens
  Native (CTG1B_HUMAN)
GPGGGAPRGPH

SEQ ID NO: 33771 - protein, 10 aa, Homo sapiens
  Native (CTG1B_HUMAN)
TQCFLPVFLA

SEQ ID NO: 33772 - protein, 9 aa, Homo sapiens
  Native (CTG1B_HUMAN)
FTVSGNILT

SEQ ID NO: 33773 - protein, 10 aa, Homo sapiens
  Native (CTG1B_HUMAN)
MWITQCFLPV

SEQ ID NO: 33774 - protein, 11 aa, Homo sapiens
  Native (CTG1B_HUMAN)
QLSISSCLQQL

SEQ ID NO: 33775 - protein, 11 aa, Homo sapiens
  Native (CTG1B_HUMAN)
GPGGPGIPDGP

SEQ ID NO: 33776 - protein, 9 aa, Homo sapiens
  Native (CTG1B_HUMAN)
RASGPGGGA

SEQ ID NO: 33777 - protein, 9 aa, Homo sapiens
  Native (CTG1B_HUMAN)
KEFTVSGNI

SEQ ID NO: 33778 - protein, 11 aa, Homo sapiens
  Native (CTG1B_HUMAN)
GNAGGPGEAGA

SEQ ID NO: 33779 - protein, 10 aa, Homo sapiens
  Native (CTG1B_HUMAN)
LKEFTVSGNI

SEQ ID NO: 33780 - protein, 11 aa, Homo sapiens
  Native (CTG1B_HUMAN)
GGNAGGPGEAG

SEQ ID NO: 33781 - protein, 10 aa, Homo sapiens
  Native (CTG1B_HUMAN)
GPESRLLEFY

SEQ ID NO: 33782 - protein, 9 aa, Homo sapiens
  Native (CTG1B_HUMAN)
MEAELARRS

SEQ ID NO: 33783 - protein, 9 aa, Homo sapiens
  Native (CTG1B_HUMAN)
TAADHRQLQ

SEQ ID NO: 33784 - protein, 9 aa, Homo sapiens
  Native (CTG1B_HUMAN)
LQQLSLLMW

SEQ ID NO: 33785 - protein, 9 aa, Homo sapiens
  Native (CTG1B_HUMAN)
MQAEGRGTG

SEQ ID NO: 33786 - protein, 8 aa, Homo sapiens
  Native (CTG1B_HUMAN)
LMWITQCF

SEQ ID NO: 33787 - protein, 11 aa, Homo sapiens
  Native (CTG1B_HUMAN)
SLAQDAPPLPV

SEQ ID NO: 33788 - protein, 10 aa, Homo sapiens
  Native (CTG1B_HUMAN)
GLNGCCRCGA

SEQ ID NO: 33789 - protein, 11 aa, Homo sapiens
  Native (CTG1B_HUMAN)
GIPDGPGGNAG

SEQ ID NO: 33790 - protein, 11 aa, Homo sapiens
  Native (CTG1B_HUMAN)
GPGEAGATGGR

SEQ ID NO: 33791 - protein, 9 aa, Homo sapiens
  Native (CTG1B_HUMAN)
LMWITQCFL

SEQ ID NO: 33792 - protein, 11 aa, Homo sapiens
  Native (CTG1B_HUMAN)
GGRGPRGAGAA

SEQ ID NO: 33793 - protein, 9 aa, Homo sapiens
  Native (CTG1B_HUMAN)
SRLLEFYLA

SEQ ID NO: 33794 - protein, 8 aa, Homo sapiens
  Native (CTG1B_HUMAN)
PESRLLEF

SEQ ID NO: 33795 - protein, 9 aa, Homo sapiens
  Native (CTG1B_HUMAN)
GATGGRGPR

SEQ ID NO: 33796 - protein, 10 aa, Homo sapiens
  Native (CTG1B_HUMAN)
MEAELARRSL

SEQ ID NO: 33797 - protein, 8 aa, Homo sapiens
  Native (CTG1B_HUMAN)
ADHRQLQL

SEQ ID NO: 33798 - protein, 11 aa, Homo sapiens
  Native (CTG1B_HUMAN)
GGAPRGPHGGA

SEQ ID NO: 33799 - protein, 11 aa, Homo sapiens
  Native (CTG1B_HUMAN)
GRGPRGAGAAR

SEQ ID NO: 33800 - protein, 11 aa, Homo sapiens
  Native (CTG1B_HUMAN)
KEFTVSGNILT

SEQ ID NO: 33801 - protein, 9 aa, Homo sapiens
  Native (CTG1B_HUMAN)
APRGPHGGA

SEQ ID NO: 33802 - protein, 11 aa, Homo sapiens
  Native (CTG1B_HUMAN)
MEAELARRSLA

SEQ ID NO: 33803 - protein, 10 aa, Homo sapiens
  Native (CTG1B_HUMAN)
TPMEAELARR

SEQ ID NO: 33804 - protein, 11 aa, Homo sapiens
  Native (CTG1B_HUMAN)
GPGIPDGPGGN

SEQ ID NO: 33805 - protein, 9 aa, Homo sapiens
  Native (CTG1B_HUMAN)
EAELARRSL

SEQ ID NO: 33806 - protein, 9 aa, Homo sapiens
  Native (CTG1B_HUMAN)
AQPPSGQRR

SEQ ID NO: 33807 - protein, 11 aa, Homo sapiens
  Native (CTG1B_HUMAN)
HGGAASGLNGC

SEQ ID NO: 33808 - protein, 8 aa, Homo sapiens
  Native (CTG1B_HUMAN)
QDAPPLPV

SEQ ID NO: 33809 - protein, 11 aa, Homo sapiens
  Native (CTG1B_HUMAN)
TGGSTGDADGP

SEQ ID NO: 33810 - protein, 9 aa, Homo sapiens
  Native (CTG1B_HUMAN)
ESRLLEFYL

SEQ ID NO: 33811 - protein, 8 aa, Homo sapiens
  Native (CTG1B_HUMAN)
GPRGAGAA

SEQ ID NO: 33812 - protein, 10 aa, Homo sapiens
  Native (CTG1B_HUMAN)
GPGEAGATGG

SEQ ID NO: 33813 - protein, 8 aa, Homo sapiens
  Native (CTG1B_HUMAN)
EAGATGGR

SEQ ID NO: 33814 - protein, 9 aa, Homo sapiens
  Native (CTG1B_HUMAN)
ADGPGGPGI

SEQ ID NO: 33815 - protein, 10 aa, Homo sapiens
  Native (CTG1B_HUMAN)
AQDAPPLPVP

SEQ ID NO: 33816 - protein, 8 aa, Homo sapiens
  Native (CTG1B_HUMAN)
ISSCLQQL

SEQ ID NO: 33817 - protein, 9 aa, Homo sapiens
  Native (CTG1B_HUMAN)
QDAPPLPVP

SEQ ID NO: 33818 - protein, 11 aa, Homo sapiens
  Native (CTG1B_HUMAN)
GEAGATGGRGP

SEQ ID NO: 33819 - protein, 11 aa, Homo sapiens
  Native (CTG1B_HUMAN)
DGPGGNAGGPG

SEQ ID NO: 33820 - protein, 8 aa, Homo sapiens
  Native (CTG1B_HUMAN)
RGPESRLL

SEQ ID NO: 33821 - protein, 11 aa, Homo sapiens
  Native (CTG1B_HUMAN)
TGDADGPGGPG

SEQ ID NO: 33822 - protein, 11 aa, Homo sapiens
  Native (CTG1B_HUMAN)
LAMPFATPMEA

SEQ ID NO: 33823 - protein, 11 aa, Homo sapiens
  Native (CTG1B_HUMAN)
FLAQPPSGQRR

SEQ ID NO: 33824 - protein, 11 aa, Homo sapiens
  Native (CTG1B_HUMAN)
LSLLMWITQCF

SEQ ID NO: 33825 - protein, 10 aa, Homo sapiens
  Native (CTG1B_HUMAN)
DADGPGGPGI

SEQ ID NO: 33826 - protein, 8 aa, Homo sapiens
  Native (CTG1B_HUMAN)
PPLPVPGV

SEQ ID NO: 33827 - protein, 9 aa, Homo sapiens
  Native (CTG1B_HUMAN)
IRLTAADHR

SEQ ID NO: 33828 - protein, 10 aa, Homo sapiens
  Native (CTG1B_HUMAN)
GEAGATGGRG

SEQ ID NO: 33829 - protein, 10 aa, Homo sapiens
  Native (CTG1B_HUMAN)
FLPVFLAQPP

SEQ ID NO: 33830 - protein, 10 aa, Homo sapiens
  Native (CTG1B_HUMAN)
RQLQLSISSC

SEQ ID NO: 33831 - protein, 11 aa, Homo sapiens
  Native (CTG1B_HUMAN)
GPGGNAGGPGE

SEQ ID NO: 33832 - protein, 9 aa, Homo sapiens
  Native (CTG1B_HUMAN)
GRGPRGAGA

SEQ ID NO: 33833 - protein, 10 aa, Homo sapiens
  Native (CTG1B_HUMAN)
GRGPRGAGAA

SEQ ID NO: 33834 - protein, 11 aa, Homo sapiens
  Native (CTG1B_HUMAN)
ATPMEAELARR

SEQ ID NO: 33835 - protein, 9 aa, Homo sapiens
  Native (CTG1B_HUMAN)
LPVPGVLLK

SEQ ID NO: 33836 - protein, 9 aa, Homo sapiens
  Native (CTG1B_HUMAN)
VPGVLLKEF

SEQ ID NO: 33837 - protein, 9 aa, Homo sapiens
  Native (CTG1B_HUMAN)
GPHGGAASG

SEQ ID NO: 33838 - protein, 9 aa, Homo sapiens
  Native (CTG1B_HUMAN)
AEGRGTGGS

SEQ ID NO: 33839 - protein, 9 aa, Homo sapiens
  Native (CTG1B_HUMAN)
TQCFLPVFL

SEQ ID NO: 33840 - protein, 9 aa, Homo sapiens
  Native (CTG1B_HUMAN)
WITQCFLPV

SEQ ID NO: 33841 - protein, 9 aa, Homo sapiens
  Native (CTG1B_HUMAN)
GGGAPRGPH

SEQ ID NO: 33842 - protein, 10 aa, Homo sapiens
  Native (CTG1B_HUMAN)
VSGNILTIRL

SEQ ID NO: 33843 - protein, 9 aa, Homo sapiens
  Native (CTG1B_HUMAN)
CLQQLSLLM

SEQ ID NO: 33844 - protein, 9 aa, Homo sapiens
  Native (CTG1B_HUMAN)
AARASGPGG

SEQ ID NO: 33845 - protein, 11 aa, Homo sapiens
  Native (CTG1B_HUMAN)
TGGRGPRGAGA

SEQ ID NO: 33846 - protein, 10 aa, Homo sapiens
  Native (CTG1B_HUMAN)
IPDGPGGNAG

SEQ ID NO: 33847 - protein, 10 aa, Homo sapiens
  Native (CTG1B_HUMAN)
LNGCCRCGAR

SEQ ID NO: 33848 - protein, 11 aa, Homo sapiens
  Native (CTG1B_HUMAN)
SLLMWITQCFL

SEQ ID NO: 33849 - protein, 10 aa, Homo sapiens
  Native (CTG1B_HUMAN)
GARGPESRLL

SEQ ID NO: 33850 - protein, 9 aa, Homo sapiens
  Native (CTG1B_HUMAN)
FLPVFLAQP

SEQ ID NO: 33851 - protein, 10 aa, Homo sapiens
  Native (CTG1B_HUMAN)
GPGIPDGPGG

SEQ ID NO: 33852 - protein, 10 aa, Homo sapiens
  Native (CTG1B_HUMAN)
MPFATPMEAE

SEQ ID NO: 33853 - protein, 10 aa, Homo sapiens
  Native (CTG1B_HUMAN)
TIRLTAADHR

SEQ ID NO: 33854 - protein, 9 aa, Homo sapiens
  Native (CTG1B_HUMAN)
ASGLNGCCR

SEQ ID NO: 33855 - protein, 11 aa, Homo sapiens
  Native (CTG1B_HUMAN)
ISSCLQQLSLL

SEQ ID NO: 33856 - protein, 10 aa, Homo sapiens
  Native (CTG1B_HUMAN)
GAPRGPHGGA

SEQ ID NO: 33857 - protein, 11 aa, Homo sapiens
  Native (CTG1B_HUMAN)
SSCLQQLSLLM

SEQ ID NO: 33858 - protein, 9 aa, Homo sapiens
  Native (CTG1B_HUMAN)
FYLAMPFAT

SEQ ID NO: 33859 - protein, 10 aa, Homo sapiens
  Native (CTG1B_HUMAN)
QQLSLLMWIT

SEQ ID NO: 33860 - protein, 8 aa, Homo sapiens
  Native (CTG1B_HUMAN)
YLAMPFAT

SEQ ID NO: 33861 - protein, 10 aa, Homo sapiens
  Native (CTG1B_HUMAN)
GGNAGGPGEA

SEQ ID NO: 33862 - protein, 9 aa, Homo sapiens
  Native (CTG1B_HUMAN)
HRQLQLSIS

SEQ ID NO: 33863 - protein, 8 aa, Homo sapiens
  Native (CTG1B_HUMAN)
EFYLAMPF

SEQ ID NO: 33864 - protein, 8 aa, Homo sapiens
  Native (CTG1B_HUMAN)
TPMEAELA

SEQ ID NO: 33865 - protein, 10 aa, Homo sapiens
  Native (CTG1B_HUMAN)
FLAQPPSGQR

SEQ ID NO: 33866 - protein, 8 aa, Homo sapiens
  Native (CTG1B_HUMAN)
FTVSGNIL

SEQ ID NO: 33867 - protein, 11 aa, Homo sapiens
  Native (CTG1B_HUMAN)
AARASGPGGGA

SEQ ID NO: 33868 - protein, 10 aa, Homo sapiens
  Native (CTG1B_HUMAN)
TGGRGPRGAG

SEQ ID NO: 33869 - protein, 10 aa, Homo sapiens
  Native (CTG1B_HUMAN)
LAQPPSGQRR

SEQ ID NO: 33870 - protein, 11 aa, Homo sapiens
  Native (CTG1B_HUMAN)
GAARASGPGGG

SEQ ID NO: 33871 - protein, 11 aa, Homo sapiens
  Native (CTG1B_HUMAN)
GGPGEAGATGG

SEQ ID NO: 33872 - protein, 8 aa, Homo sapiens
  Native (CTG1B_HUMAN)
VLLKEFTV

SEQ ID NO: 33873 - protein, 10 aa, Homo sapiens
  Native (CTG1B_HUMAN)
ASGPGGGAPR

SEQ ID NO: 33874 - protein, 10 aa, Homo sapiens
  Native (CTG1B_HUMAN)
LQQLSLLMWI

SEQ ID NO: 33875 - protein, 11 aa, Homo sapiens
  Native (CTG1B_HUMAN)
LPVFLAQPPSG

SEQ ID NO: 33876 - protein, 10 aa, Homo sapiens
  Native (CTG1B_HUMAN)
ADHRQLQLSI

SEQ ID NO: 33877 - protein, 9 aa, Homo sapiens
  Native (CTG1B_HUMAN)
EFTVSGNIL

SEQ ID NO: 33878 - protein, 10 aa, Homo sapiens
  Native (CTG1B_HUMAN)
ATPMEAELAR

SEQ ID NO: 33879 - protein, 10 aa, Homo sapiens
  Native (CTG1B_HUMAN)
ARASGPGGGA

SEQ ID NO: 33880 - protein, 11 aa, Homo sapiens
  Native (CTG1B_HUMAN)
GPRGAGAARAS

SEQ ID NO: 33881 - protein, 11 aa, Homo sapiens
  Native (CTG1B_HUMAN)
APPLPVPGVLL

SEQ ID NO: 33882 - protein, 10 aa, Homo sapiens
  Native (CTG1B_HUMAN)
CLQQLSLLMW

SEQ ID NO: 33883 - protein, 10 aa, Homo sapiens
  Native (CTG1B_HUMAN)
RGPRGAGAAR

SEQ ID NO: 33884 - protein, 11 aa, Homo sapiens
  Native (CTG1B_HUMAN)
GGGAPRGPHGG

SEQ ID NO: 33885 - protein, 11 aa, Homo sapiens
  Native (CTG1B_HUMAN)
SGPGGGAPRGP

SEQ ID NO: 33886 - protein, 8 aa, Homo sapiens
  Native (CTG1B_HUMAN)
ATPMEAEL

SEQ ID NO: 33887 - protein, 11 aa, Homo sapiens
  Native (CTG1B_HUMAN)
ADGPGGPGIPD

SEQ ID NO: 33888 - protein, 9 aa, Homo sapiens
  Native (CTG1B_HUMAN)
DAPPLPVPG

SEQ ID NO: 33889 - protein, 11 aa, Homo sapiens
  Native (CTG1B_HUMAN)
GAASGLNGCCR

SEQ ID NO: 33890 - protein, 10 aa, Homo sapiens
  Native (CTG1B_HUMAN)
LAMPFATPME

SEQ ID NO: 33891 - protein, 11 aa, Homo sapiens
  Native (CTG1B_HUMAN)
MPFATPMEAEL

SEQ ID NO: 33892 - protein, 10 aa, Homo sapiens
  Native (CTG1B_HUMAN)
GGPGEAGATG

SEQ ID NO: 33893 - protein, 8 aa, Homo sapiens
  Native (CTG1B_HUMAN)
RLLEFYLA

SEQ ID NO: 33894 - protein, 9 aa, Homo sapiens
  Native (CTG1B_HUMAN)
PLPVPGVLL

SEQ ID NO: 33895 - protein, 8 aa, Homo sapiens
  Native (CTG1B_HUMAN)
VSGNILTI

SEQ ID NO: 33896 - protein, 10 aa, Homo sapiens
  Native (CTG1B_HUMAN)
NILTIRLTAA

SEQ ID NO: 33897 - protein, 11 aa, Homo sapiens
  Native (CTG1B_HUMAN)
FTVSGNILTIR

SEQ ID NO: 33898 - protein, 9 aa, Artificial Sequence
  Description of Artificial Sequence: Synthetic peptide
  Seed: AADHRQLQL (CTG1B_HUMAN)
  misc_feature (2)..(2): Xaa can be Glu, Thr, Ala, Ile, Arg, Ser, Val, Tyr, Phe, Met, Gln, Leu, Trp, Gly, Asp, Pro, Cys, Lys, His, or Asn
  misc_feature (9)..(9): Xaa can be Phe, Tyr, Trp, Ile, Leu, Val, Met, Cys, Ala, Arg, Lys, Thr, His, Gln, Ser, Pro, or Gly
AXDHRQLQX

SEQ ID NO: 33899 - protein, 11 aa, Artificial Sequence
  Description of Artificial Sequence: Synthetic peptide
  Seed: AADHRQLQLSI (CTG1B_HUMAN)
  misc_feature (2)..(2): Xaa can be Ala, Ser, Thr, Val, Ile, Cys, Gly, or Leu
  misc_feature (11)..(11): Xaa can be Leu, Met, Phe, Ile, or Val
AXDHRQLQLSX

SEQ ID NO: 33900 - protein, 9 aa, Artificial Sequence
  Description of Artificial Sequence: Synthetic peptide
  Seed: AARASGPGG (CTG1B_HUMAN)
  misc_feature (2)..(2): Xaa can be Thr, Val, Ser, Ala, Tyr, Met, Phe, Ile, Leu, Gln, Gly, Trp, Asn, Cys, His, Arg, or Lys
  misc_feature (9)..(9): Xaa can be Lys, Ala, Ile, Val, Met, Ser, Leu, Arg, Tyr, Gly, Thr, Phe, Pro, Asn, Cys, Gln, His, Glu, Trp, or Asp
AXRASGPGX

SEQ ID NO: 33901 - protein, 11 aa, Artificial Sequence
  Description of Artificial Sequence: Synthetic peptide
  Seed: AARASGPGGGA (CTG1B_HUMAN)
  misc_feature (2)..(2): Xaa can be Pro, Ala, Ser, Val, Thr, Gly, Ile, Met, Cys, Gln, Glu, Leu, Asn, Asp, or Phe
  misc_feature (11)..(11): Xaa can be Tyr, Lys, Phe, Arg, Met, His, Trp, Leu, Ala, Ile, Val, Cys, Gln, Thr, Asn, Ser, Gly, Glu, Pro, or Asp
AXRASGPGGGX

SEQ ID NO: 33902 - protein, 10 aa, Artificial Sequence
  Description of Artificial Sequence: Synthetic peptide
  Seed: AASGLNGCCR (CTG1B_HUMAN)
  misc_feature (2)..(2): Xaa can be Ala, Ser, Thr, Ile, Val, Gly, Gln, Leu, Met, Glu, Cys, Asn, Trp, Tyr, Phe, Asp, His, or Pr o
  misc_feature (10)..(10): Xaa can be Arg, Lys, Tyr, Phe, Met, Leu, His, Val, Trp, or Ile
AXSGLNGCCX

SEQ ID NO: 33903 - protein, 9 aa, Artificial Sequence
  Description of Artificial Sequence: Synthetic peptide
  Seed: ADGPGGPGI (CTG1B_HUMAN)
  misc_feature (2)..(2): Xaa can be Glu, Asp, Gln, Ala, Ser, or Val
  misc_feature (9)..(9): Xaa can be Leu, Phe, Met, Ala, Val, Ile, Cys, Pro, Tyr, Trp, Arg, Lys, Thr, Ser, Gln, Glu, Asp, Gly, or Asn
AXGPGGPGX

SEQ ID NO: 33904 - protein, 11 aa, Artificial Sequence
  Description of Artificial Sequence: Synthetic peptide
  Seed: ADGPGGPGIPD (CTG1B_HUMAN)
  misc_feature (2)..(2): Xaa can be Ile, Gln, Glu, Pro, Ala, Val, Gly, Arg, Ser, Asn, Thr, Asp, Met, Leu, Phe, Trp, Cys, His, Tyr, or Lys
  misc_feature (11)..(11): Xaa can be Gly, Arg, Glu, Met, Lys, Tyr, Asn, Trp, His, Phe, Gln, Leu, Ile, Asp, Pro, Ser, Cys, Ala, Val, or Thr
AXGPGGPGIPX

SEQ ID NO: 33905 - protein, 8 aa, Artificial Sequence
  Description of Artificial Sequence: Synthetic peptide
  Seed: ADHRQLQL (CTG1B_HUMAN)
  misc_feature (2)..(2): Xaa can be Glu, Asp, Gln, Arg, Gly, Asn, Ala, Tyr, Ser, or His
  misc_feature (8)..(8): Xaa can be Leu, Ile, Met, Tyr, Val, Cys, Trp, Ala, Phe, Ser, Pro, Thr, or Gly
AXHRQLQX

SEQ ID NO: 33906 - protein, 10 aa, Artificial Sequence
  Description of Artificial Sequence: Synthetic peptide
  Seed: ADHRQLQLSI (CTG1B_HUMAN)
  misc_feature (2)..(2): Xaa can be Glu, or Asp
  misc_feature (10)..(10): Xaa can be Val, Leu, Met, Ile, Thr, Trp, Gly, Tyr, Ala, Cys, Pro, Phe, or Ser
AXHRQLQLSX

SEQ ID NO: 33907 - protein, 9 aa, Artificial Sequence
  Description of Artificial Sequence: Synthetic peptide
  Seed: AEGRGTGGS (CTG1B_HUMAN)
  misc_feature (2)..(2): Xaa can be , or Glu
  misc_feature (9)..(9): Xaa can be Thr, Val, Met, Cys, Ala, Gly, Ile, Leu, Phe, Ser, or Pro
AXGRGTGGX

SEQ ID NO: 33908 - protein, 10 aa, Artificial Sequence
  Description of Artificial Sequence: Synthetic peptide
  Seed: AEGRGTGGST (CTG1B_HUMAN)
  misc_feature (2)..(2): Xaa can be Glu, or Asp
  misc_feature (10)..(10): Xaa can be Leu, Val, Ala, Cys, Gly, Pro, Phe, Ser, Thr, Ile, Met, Trp, or Tyr
AXGRGTGGSX

SEQ ID NO: 33909 - protein, 11 aa, Artificial Sequence
  Description of Artificial Sequence: Synthetic peptide
  Seed: AEGRGTGGSTG (CTG1B_HUMAN)
  misc_feature (2)..(2): Xaa can be Glu, Asp, or Gln
  misc_feature (11)..(11): Xaa can be Cys, Phe, Leu, Met, Ala, Ile, Val, Pro, Trp, Ser, Asp, Tyr, Gly, or Thr
AXGRGTGGSTX

SEQ ID NO: 33910 - protein, 8 aa, Artificial Sequence
  Description of Artificial Sequence: Synthetic peptide
  Seed: AELARRSL (CTG1B_HUMAN)
  misc_feature (2)..(2): Xaa can be Glu, Asp, His, Gln, Ala, Ser, Pro, or Arg
  misc_feature (8)..(8): Xaa can be Leu, Val, Ile, Met, Trp, Phe, Tyr, Cys, Pro, Thr, or Ala
AXLARRSX

SEQ ID NO: 33911 - protein, 9 aa, Artificial Sequence
  Description of Artificial Sequence: Synthetic peptide
  Seed: AELARRSLA (CTG1B_HUMAN)
  misc_feature (2)..(2): Xaa can be Glu, Asp, or Gln
  misc_feature (9)..(9): Xaa can be Leu, Phe, Met, Ala, Ile, Pro, Val, Cys, Trp, Tyr, Thr, Ser, or Gly
AXLARRSLX

SEQ ID NO: 33912 - protein, 10 aa, Artificial Sequence
  Description of Artificial Sequence: Synthetic peptide
  Seed: AGATGGRGPR (CTG1B_HUMAN)
  misc_feature (2)..(2): Xaa can be Ala, Gly, Arg, Thr, Ile, Ser, Val, Met, Leu, Gln, Glu, Asn, Pro, Tyr, Cys, Asp, Phe, or Tr p
  misc_feature (10)..(10): Xaa can be Arg, Lys, Tyr, Phe, Met, Leu, His, Val, Ile, Trp, Gln, Glu, Ala, or Asn
AXATGGRGPX

SEQ ID NO: 33913 - protein, 11 aa, Artificial Sequence
  Description of Artificial Sequence: Synthetic peptide
  Seed: AGGPGEAGATG (CTG1B_HUMAN)
  misc_feature (2)..(2): Xaa can be Arg, Gly, Ala, Gln, Asn, Val, Ser, Glu, Ile, Asp, Pro, Thr, Leu, Met, Trp, His, Lys, Cys, Phe, or Tyr
  misc_feature (11)..(11): Xaa can be Phe, Lys, His, Leu, Arg, Tyr, Asn, Glu, Met, Gln, Trp, Gly, Ile, Asp, Cys, Val, Ser, Ala, Pro, or Thr
AXGPGEAGATX

SEQ ID NO: 33914 - protein, 8 aa, Artificial Sequence
  Description of Artificial Sequence: Synthetic peptide
  Seed: AMPFATPM (CTG1B_HUMAN)
  misc_feature (2)..(2): Xaa can be Gln, Met, Ala, Ser, Lys, His, Tyr, Phe, Ile, Leu, or Arg
  misc_feature (8)..(8): Xaa can be Tyr, Phe, Met, or Leu
AXPFATPX

SEQ ID NO: 33915 - protein, 10 aa, Artificial Sequence
  Description of Artificial Sequence: Synthetic peptide
  Seed: AMPFATPMEA (CTG1B_HUMAN)
  misc_feature (2)..(2): Xaa can be Met, Phe, Tyr, Leu, Pro, Thr, Gln, Arg, Asp, Lys, Trp, Cys, Ile, His, Ser, Gly, Val, Ala, Asn, or Glu
  misc_feature (10)..(10): Xaa can be Val, Ile, Phe, Tyr, Leu, Met, Ala, Thr, His, Ser, Cys, or Trp
AXPFATPMEX

SEQ ID NO: 33916 - protein, 8 aa, Artificial Sequence
  Description of Artificial Sequence: Synthetic peptide
  Seed: APPLPVPG (CTG1B_HUMAN)
  misc_feature (2)..(2): Xaa can be , or Pro
  misc_feature (8)..(8): Xaa can be Ile, Phe, Val, Leu, Gly, Cys, Met, Thr, Ala, Pro, or Ser
AXPLPVPX

SEQ ID NO: 33917 - protein, 9 aa, Artificial Sequence
  Description of Artificial Sequence: Synthetic peptide
  Seed: APPLPVPGV (CTG1B_HUMAN)
  misc_feature (2)..(2): Xaa can be Pro, Ala, Ser, Gly, Gln, Val, His, Ile, Thr, Leu, Met, Arg, Asn, Glu, Asp, Tyr, Trp, Cys, Lys, or Phe
  misc_feature (9)..(9): Xaa can be Ile, Leu, Val, Met, Phe, Tyr, Arg, Cys, Lys, Ala, Trp, Thr, Ser, Pro, Gln, Gly, His, Glu, or Asn
AXPLPVPGX

SEQ ID NO: 33918 - protein, 10 aa, Artificial Sequence
  Description of Artificial Sequence: Synthetic peptide
  Seed: APPLPVPGVL (CTG1B_HUMAN)
  misc_feature (2)..(2): Xaa can be Pro, Ala, Val, Arg, Met, Trp, Asn, Ser, Ile, Thr, Leu, His, Asp, Tyr, Glu, Cys, Gln, Phe, Gly, or Lys
  misc_feature (10)..(10): Xaa can be Val, Leu, Met, Ile, Phe, Ala, Cys, Tyr, Lys, Gly, Gln, Glu, Thr, Arg, His, Ser, Trp, or Pr o
AXPLPVPGVX

SEQ ID NO: 33919 - protein, 11 aa, Artificial Sequence
  Description of Artificial Sequence: Synthetic peptide
  Seed: APPLPVPGVLL (CTG1B_HUMAN)
  misc_feature (2)..(2): Xaa can be Pro, Ala, Gly, Ser, Val, Leu, Met, Cys, Thr, or Ile
  misc_feature (11)..(11): Xaa can be Met, Leu, Phe, Ala, Val, Ile, Cys, Arg, Lys, Gly, Trp, Pro, Thr, Ser, or Tyr
AXPLPVPGVLX

SEQ ID NO: 33920 - protein, 9 aa, Artificial Sequence
  Description of Artificial Sequence: Synthetic peptide
  Seed: APRGPHGGA (CTG1B_HUMAN)
  misc_feature (2)..(2): Xaa can be Pro, Ala, Val, Ile, Gly, Thr, Ser, Leu, or Met
  misc_feature (9)..(9): Xaa can be Leu, Met, Ala, Phe, Ile, Val, Pro, Thr, Cys, Gln, Tyr, Lys, Ser, Asn, Glu, Arg, Trp, His, or Gly
AXRGPHGGX

SEQ ID NO: 33921 - protein, 10 aa, Artificial Sequence
  Description of Artificial Sequence: Synthetic peptide
  Seed: APRGPHGGAA (CTG1B_HUMAN)
  misc_feature (2)..(2): Xaa can be Pro, Ala, His, Ile, Val, Gln, Ser, Gly, Met, Thr, Leu, Cys, Arg, or Glu
  misc_feature (10)..(10): Xaa can be Ala, Met, Leu, Ile, Phe, Val, Cys, Gly, Pro, Thr, Ser, Trp, Lys, Tyr, Gln, Asp, His, Asn, Glu, or Arg
AXRGPHGGAX

SEQ ID NO: 33922 - protein, 11 aa, Artificial Sequence
  Description of Artificial Sequence: Synthetic peptide
  Seed: APRGPHGGAAS (CTG1B_HUMAN)
  misc_feature (2)..(2): Xaa can be Pro, Ala, Ile, Gly, Val, Met, Thr, Ser, Cys, Leu, Gln, Asp, or Glu
  misc_feature (11)..(11): Xaa can be Leu, Ala, Met, Cys, Phe, Ile, Val, Gly, Ser, Tyr, Trp, Thr, Pro, Gln, Glu, Arg, Asn, Lys, Asp, or His
AXRGPHGGAAX

SEQ ID NO: 33923 - protein, 9 aa, Artificial Sequence
  Description of Artificial Sequence: Synthetic peptide
  Seed: AQDAPPLPV (CTG1B_HUMAN)
  misc_feature (2)..(2): Xaa can be Ala, Glu, Phe, Tyr, Ser, Thr, Val, Ile, Arg, Asp, Trp, His, Leu, Met, Gln, Cys, Gly, Pro, Asn, or Lys
  misc_feature (9)..(9): Xaa can be Phe, Leu, Val, Met, Lys, Tyr, Ile, Ala, Arg, Cys, Thr, Trp, Pro, Ser, Gly, His, Gln, Glu, Asn, or Asp
AXDAPPLPX

SEQ ID NO: 33924 - protein, 10 aa, Artificial Sequence
  Description of Artificial Sequence: Synthetic peptide
  Seed: AQDAPPLPVP (CTG1B_HUMAN)
  misc_feature (2)..(2): Xaa can be Glu, Asp, or Gln
  misc_feature (10)..(10): Xaa can be Val, Gly, Leu, Phe, Cys, Ser, Thr, Ile, Met, Ala, Pro, Glu, Asn, His, Gln, Trp, Lys, Tyr, Arg, or Asp
AXDAPPLPVX

SEQ ID NO: 33925 - protein, 9 aa, Artificial Sequence
  Description of Artificial Sequence: Synthetic peptide
  Seed: AQPPSGQRR (CTG1B_HUMAN)
  misc_feature (2)..(2): Xaa can be Ala, Thr, Ser, Leu, Val, Ile, Gln, Gly, Met, Phe, Asn, Tyr, Cys, Pro, Trp, Asp, Arg, or Gl u
  misc_feature (9)..(9): Xaa can be Leu, Tyr, Met, Phe, Val, Ile, Lys, Arg, Trp, Ala, Cys, Thr, or His
AXPPSGQRX

SEQ ID NO: 33926 - protein, 10 aa, Artificial Sequence
  Description of Artificial Sequence: Synthetic peptide
  Seed: ARASGPGGGA (CTG1B_HUMAN)
  misc_feature (2)..(2): Xaa can be Gly, Arg, His, Gln, Ala, Ile, Asn, Val, Pro, Leu, Ser, Asp, Thr, Met, Glu, Phe, Tyr, Lys, Trp, or Cys
  misc_feature (10)..(10): Xaa can be Phe, Leu, Arg, Tyr, Lys, Met, His, Asn, Gln, Glu, Gly, Ile, Ala, Val, Trp, Thr, Pro, Cys, Ser, or Asp
AXASGPGGGX

SEQ ID NO: 33927 - protein, 11 aa, Artificial Sequence
  Description of Artificial Sequence: Synthetic peptide
  Seed: ARASGPGGGAP (CTG1B_HUMAN)
  misc_feature (2)..(2): Xaa can be Ala, Gly, Asn, Arg, Ile, Ser, Val, Gln, Thr, His, Leu, Pro, Met, Asp, Phe, Cys, Trp, Lys, Tyr, or Glu
  misc_feature (11)..(11): Xaa can be Leu, Glu, Gln, Lys, Asn, Gly, Phe, Tyr, Trp, Arg, Met, His, Ile, Asp, Cys, Ser, Pro, Val, Ala, or Thr
AXASGPGGGAX

SEQ ID NO: 33928 - protein, 8 aa, Artificial Sequence
  Description of Artificial Sequence: Synthetic peptide
  Seed: ARGPESRL (CTG1B_HUMAN)
  misc_feature (2)..(2): Xaa can be Arg, Tyr, His, Phe, Ser, Ala, Glu, Gly, Thr, or Gln
  misc_feature (8)..(8): Xaa can be Leu, Phe, Tyr, Met, or Ile
AXGPESRX

SEQ ID NO: 33929 - protein, 9 aa, Artificial Sequence
  Description of Artificial Sequence: Synthetic peptide
  Seed: ARGPESRLL (CTG1B_HUMAN)
  misc_feature (2)..(2): Xaa can be Arg, His, Gly, Gln, Ser, Phe, Ile, Ala, Thr, Val, Tyr, Met, Leu, Asn, Trp, Lys, Glu, Asp, Pro, or Cys
  misc_feature (9)..(9): Xaa can be Leu, Met, Phe, Tyr, Ile, Val, Lys, Cys, Trp, Thr, Gln, Ala, His, or Arg
AXGPESRLX

SEQ ID NO: 33930 - protein, 11 aa, Artificial Sequence
  Description of Artificial Sequence: Synthetic peptide
  Seed: ARGPESRLLEF (CTG1B_HUMAN)
  misc_feature (2)..(2): Xaa can be Arg, Gln, Ala, Tyr, Gly, Phe, Glu, His, Met, Lys, Leu, Ser, Trp, Val, Thr, or Ile
  misc_feature (11)..(11): Xaa can be Leu, Phe, Tyr, Met, Lys, Trp, Ile, Arg, Ala, Cys, Gln, Val, His, or Thr
AXGPESRLLEX

SEQ ID NO: 33931 - protein, 9 aa, Artificial Sequence
  Description of Artificial Sequence: Synthetic peptide
  Seed: ASGLNGCCR (CTG1B_HUMAN)
  misc_feature (2)..(2): Xaa can be Ala, Ile, Ser, Val, Thr, Met, Leu, or Asp
  misc_feature (9)..(9): Xaa can be Tyr, Lys, or Arg
AXGLNGCCX

SEQ ID NO: 33932 - protein, 9 aa, Artificial Sequence
  Description of Artificial Sequence: Synthetic peptide
  Seed: ASGPGGGAP (CTG1B_HUMAN)
  misc_feature (2)..(2): Xaa can be Ala, Ser, Thr, Val, Ile, Gln, Met, Leu, Gly, Cys, Glu, Asn, Pro, Phe, Asp, Lys, Tyr, Trp, His, or Arg
  misc_feature (9)..(9): Xaa can be Tyr, Phe, Met, Arg, Lys, Leu, His, Val, Trp, Ala, Ile, Gln, Cys, Thr, Ser, Pro, Asn, Gly, or Glu
AXGPGGGAX

SEQ ID NO: 33933 - protein, 10 aa, Artificial Sequence
  Description of Artificial Sequence: Synthetic peptide
  Seed: ASGPGGGAPR (CTG1B_HUMAN)
  misc_feature (2)..(2): Xaa can be Gly, Ala, Val, Arg, Pro, Thr, Ser, Ile, Leu, Asn, Gln, Met, Glu, Tyr, Cys, Phe, Asp, Trp, His, or Lys
  misc_feature (10)..(10): Xaa can be Leu, Asn, Glu, Gln, Met, Lys, Phe, Arg, His, Tyr, Trp, Ile, Val, Gly, Ala, Ser, Cys, Thr, Asp, or Pro
AXGPGGGAPX

SEQ ID NO: 33934 - protein, 11 aa, Artificial Sequence
  Description of Artificial Sequence: Synthetic peptide
  Seed: ASGPGGGAPRG (CTG1B_HUMAN)
  misc_feature (2)..(2): Xaa can be Gly, Arg, Ala, Gln, Pro, Ile, Asn, Ser, Val, Cys, Leu, Thr, Met, Asp, Glu, His, Lys, Phe, Trp, or Tyr
  misc_feature (11)..(11): Xaa can be Lys, Arg, Phe, Leu, Asn, Tyr, Glu, Met, His, Gln, Gly, Ile, Pro, Trp, Cys, Asp, Ser, Val, Thr, or Ala
AXGPGGGAPRX

SEQ ID NO: 33935 - protein, 8 aa, Artificial Sequence
  Description of Artificial Sequence: Synthetic peptide
  Seed: ATPMEAEL (CTG1B_HUMAN)
  misc_feature (2)..(2): Xaa can be Ala, Ser, Thr, Val, Gly, Ile, Asp, Leu, Pro, Tyr, His, Asn, Phe, Cys, Arg, Met, Glu, or Gl n
  misc_feature (8)..(8): Xaa can be Leu, Met, Phe, Tyr, Ile, Lys, or Val
AXPMEAEX

SEQ ID NO: 33936 - protein, 10 aa, Artificial Sequence
  Description of Artificial Sequence: Synthetic peptide
  Seed: ATPMEAELAR (CTG1B_HUMAN)
  misc_feature (2)..(2): Xaa can be Ser, Thr, Ala, Met, Leu, Ile, Val, Asp, Glu, Asn, Gln, Gly, Trp, Phe, or Tyr
  misc_feature (10)..(10): Xaa can be Arg, Lys, Tyr, Leu, Phe, or Met
AXPMEAELAX

SEQ ID NO: 33937 - protein, 11 aa, Artificial Sequence
  Description of Artificial Sequence: Synthetic peptide
  Seed: ATPMEAELARR (CTG1B_HUMAN)
  misc_feature (2)..(2): Xaa can be Val, Thr, Ile, Met, Leu, or Ala
  misc_feature (11)..(11): Xaa can be Lys, or Arg
AXPMEAELARX

SEQ ID NO: 33938 - protein, 9 aa, Artificial Sequence
  Description of Artificial Sequence: Synthetic peptide
  Seed: CGARGPESR (CTG1B_HUMAN)
  misc_feature (2)..(2): Xaa can be Ala, Ser, Val, Thr, Ile, Gly, Leu, Met, Gln, Pro, Phe, Tyr, Trp, or Asn
  misc_feature (9)..(9): Xaa can be Arg, Leu, Met, Lys, Phe, Val, Tyr, or Ile
CXARGPESX

SEQ ID NO: 33939 - protein, 9 aa, Artificial Sequence
  Description of Artificial Sequence: Synthetic peptide
  Seed: CLQQLSLLM (CTG1B_HUMAN)
  misc_feature (2)..(2): Xaa can be Met, Gln, Leu, Ala, Val, Ile, Thr, Ser, Gly, Asn, Glu, Lys, Phe, His, Arg, Pro, Tyr, Cys, or Trp
  misc_feature (9)..(9): Xaa can be Tyr, Phe, Met, Leu, Val, Ile, Trp, Ala, or His
CXQQLSLLX

SEQ ID NO: 33940 - protein, 10 aa, Artificial Sequence
  Description of Artificial Sequence: Synthetic peptide
  Seed: CLQQLSLLMW (CTG1B_HUMAN)
  misc_feature (2)..(2): Xaa can be Thr, Ser, Gln, Val, Ala, Cys, Met, Lys, Arg, His, Phe, Asp, Glu, Asn, Gly, Ile, Leu, Pro, Trp, or Tyr
  misc_feature (10)..(10): Xaa can be Trp, Phe, Leu, Met, Tyr, or Ile
CXQQLSLLMX

SEQ ID NO: 33941 - protein, 11 aa, Artificial Sequence
  Description of Artificial Sequence: Synthetic peptide
  Seed: CRCGARGPESR (CTG1B_HUMAN)
  misc_feature (2)..(2): Xaa can be Gly, Arg, Gln, Asn, Ala, Pro, Ser, Val, Ile, Thr, Met, Glu, Leu, or Asp
  misc_feature (11)..(11): Xaa can be Phe, Lys, Leu, Tyr, Ile, Arg, Met, Gln, Glu, Trp, His, or Asn
CXCGARGPESX

SEQ ID NO: 33942 - protein, 10 aa, Artificial Sequence
  Description of Artificial Sequence: Synthetic peptide
  Seed: DADGPGGPGI (CTG1B_HUMAN)
  misc_feature (2)..(2): Xaa can be Pro, Ala, Ser, Val, Met, Thr, Gly, Leu, Ile, Tyr, Phe, Cys, Gln, Asn, or Trp
  misc_feature (10)..(10): Xaa can be Met, Leu, Phe, Ile, Val, Tyr, Trp, or Ala
DXDGPGGPGX

SEQ ID NO: 33943 - protein, 9 aa, Artificial Sequence
  Description of Artificial Sequence: Synthetic peptide
  Seed: DAPPLPVPG (CTG1B_HUMAN)
  misc_feature (2)..(2): Xaa can be Pro, Ala, Val, Gly, Ser, Ile, Thr, Met, Leu, Cys, Gln, Phe, Asp, Glu, Asn, Arg, or Tyr
  misc_feature (9)..(9): Xaa can be Val, Leu, Ile, Ala, Met, Cys, Phe, Thr, Pro, Gly, Ser, Arg, Tyr, Lys, or Trp
DXPPLPVPX

SEQ ID NO: 33944 - protein, 10 aa, Artificial Sequence
  Description of Artificial Sequence: Synthetic peptide
  Seed: DAPPLPVPGV (CTG1B_HUMAN)
  misc_feature (2)..(2): Xaa can be Pro, Ala, Val, Thr, Ser, Ile, Met, Leu, Gly, Gln, or Glu
  misc_feature (10)..(10): Xaa can be Val, Ile, Leu, Ala, Met, Cys, Phe, or Thr
DXPPLPVPGX

SEQ ID NO: 33945 - protein, 11 aa, Artificial Sequence
  Description of Artificial Sequence: Synthetic peptide
  Seed: DAPPLPVPGVL (CTG1B_HUMAN)
  misc_feature (2)..(2): Xaa can be Ala, Pro, or Met
  misc_feature (11)..(11): Xaa can be Leu, Val, Ile, or Met
DXPPLPVPGVX

SEQ ID NO: 33946 - protein, 11 aa, Artificial Sequence
  Description of Artificial Sequence: Synthetic peptide
  Seed: DGPGGNAGGPG (CTG1B_HUMAN)
  misc_feature (2)..(2): Xaa can be Gly, Arg, Ala, Pro, Met, Leu, Gln, Ile, Thr, Asn, Val, Ser, Cys, Glu, Phe, Lys, His, Trp, Tyr, or Asp
  misc_feature (11)..(11): Xaa can be Lys, Arg, Phe, Glu, Asn, Tyr, His, Gln, Leu, Met, Gly, Asp, Trp, Pro, Ser, Val, Ala, or Il e
DXPGGNAGGPX

SEQ ID NO: 33947 - protein, 9 aa, Artificial Sequence
  Description of Artificial Sequence: Synthetic peptide
  Seed: DHRQLQLSI (CTG1B_HUMAN)
  misc_feature (2)..(2): Xaa can be His, Arg, Gln, Lys, Glu, Asn, Ala, Met, Ser, Asp, Gly, Leu, Tyr, Ile, Pro, or Val
  misc_feature (9)..(9): Xaa can be Leu, Phe, Tyr, Met, Ile, Val, Ala, Cys, Thr, Pro, Trp, or Ser
DXRQLQLSX

SEQ ID NO: 33948 - protein, 9 aa, Artificial Sequence
  Description of Artificial Sequence: Synthetic peptide
  Seed: EAELARRSL (CTG1B_HUMAN)
  misc_feature (2)..(2): Xaa can be Ala, Pro, Tyr, Ser, Val, Arg, Gln, Met, Ile, Leu, Phe, Thr, His, or Trp
  misc_feature (9)..(9): Xaa can be Leu, Met, Phe, Tyr, Ile, Val, or Ala
EXELARRSX

SEQ ID NO: 33949 - protein, 8 aa, Artificial Sequence
  Description of Artificial Sequence: Synthetic peptide
  Seed: EAGATGGR (CTG1B_HUMAN)
  misc_feature (2)..(2): Xaa can be Val, Ile, Ala, Thr, or Ser
  misc_feature (8)..(8): Xaa can be Arg, or Lys
EXGATGGX

SEQ ID NO: 33950 - protein, 11 aa, Artificial Sequence
  Description of Artificial Sequence: Synthetic peptide
  Seed: EAGATGGRGPR (CTG1B_HUMAN)
  misc_feature (2)..(2): Xaa can be Val, Thr, Glu, Trp, Gln, Ser, Ala, Leu, Asn, Phe, Tyr, Ile, Gly, Met, Cys, Asp, Pro, or Hi s
  misc_feature (11)..(11): Xaa can be Arg, Lys, His, Tyr, Gln, or Met
EXGATGGRGPX

SEQ ID NO: 33951 - protein, 9 aa, Artificial Sequence
  Description of Artificial Sequence: Synthetic peptide
  Seed: EFTVSGNIL (CTG1B_HUMAN)
  misc_feature (2)..(2): Xaa can be Tyr, Phe, or Trp
  misc_feature (9)..(9): Xaa can be Phe, Leu, Tyr, or Met
EXTVSGNIX

SEQ ID NO: 33952 - protein, 10 aa, Artificial Sequence
  Description of Artificial Sequence: Synthetic peptide
  Seed: EFTVSGNILT (CTG1B_HUMAN)
  misc_feature (2)..(2): Xaa can be Val, Met, Cys, Ser, Tyr, Ala, Gly, Phe, Thr, Glu, Lys, Pro, Arg, Trp, His, Ile, Leu, Asp, Asn, or Gln
  misc_feature (10)..(10): Xaa can be Ile, Thr, Met, Ala, Val, or Leu
EXTVSGNILX

SEQ ID NO: 33953 - protein, 8 aa, Artificial Sequence
  Description of Artificial Sequence: Synthetic peptide
  Seed: EFYLAMPF (CTG1B_HUMAN)
  misc_feature (2)..(2): Xaa can be Glu, Trp, Tyr, Phe, Met, His, Gln, Ile, Leu, Ala, Asn, Lys, Ser, Val, Arg, Thr, Asp, or Cy s
  misc_feature (8)..(8): Xaa can be Tyr, Phe, Met, Leu, Ser, Ile, Ala, Thr, Trp, Val, or His
EXYLAMPX

SEQ ID NO: 33954 - protein, 9 aa, Artificial Sequence
  Description of Artificial Sequence: Synthetic peptide
  Seed: ESRLLEFYL (CTG1B_HUMAN)
  misc_feature (2)..(2): Xaa can be Thr, Ser, Val, Ala, Ile, Met, Cys, Leu, Gln, Asn, or Gly
  misc_feature (9)..(9): Xaa can be Trp, Val, Phe, Ile, Leu, Ala, Tyr, Thr, or Met
EXRLLEFYX

SEQ ID NO: 33955 - protein, 9 aa, Artificial Sequence
  Description of Artificial Sequence: Synthetic peptide
  Seed: FATPMEAEL (CTG1B_HUMAN)
  misc_feature (2)..(2): Xaa can be Pro, Met, Ala, Leu, Arg, Thr, Val, Ile, Ser, Gln, Tyr, Phe, His, Gly, Asn, Cys, Trp, Asp, Glu, or Lys
  misc_feature (9)..(9): Xaa can be Leu, Met, Phe, Tyr, Ile, Trp, Val, Lys, Arg, His, Ala, Cys, Thr, Ser, Pro, Gly, Gln, Asn, or Glu
FXTPMEAEX

SEQ ID NO: 33956 - protein, 11 aa, Artificial Sequence
  Description of Artificial Sequence: Synthetic peptide
  Seed: FATPMEAELAR (CTG1B_HUMAN)
  misc_feature (2)..(2): Xaa can be Ser, Thr, Ala, Val, Gly, Met, Ile, Leu, Gln, Cys, Asp, Glu, Phe, Asn, Trp, or Tyr
  misc_feature (11)..(11): Xaa can be Arg, Lys, Phe, Leu, Tyr, Met, Trp, His, Ile, or Val
FXTPMEAELAX

SEQ ID NO: 33957 - protein, 10 aa, Artificial Sequence
  Description of Artificial Sequence: Synthetic peptide
  Seed: FLAQPPSGQR (CTG1B_HUMAN)
  misc_feature (2)..(2): Xaa can be Ala, Val, Thr, Ile, Gly, Met, Ser, Leu, Asn, Cys, Tyr, Phe, Gln, Pro, Trp, Glu, Arg, His, Lys, or Asp
  misc_feature (10)..(10): Xaa can be Arg, Lys, Tyr, Met, Leu, Phe, Trp, Ile, Val, His, Thr, Cys, or Ala
FXAQPPSGQX

SEQ ID NO: 33958 - protein, 11 aa, Artificial Sequence
  Description of Artificial Sequence: Synthetic peptide
  Seed: FLAQPPSGQRR (CTG1B_HUMAN)
  misc_feature (2)..(2): Xaa can be Val, Met, Leu, Thr, Ile, Gln, Tyr, Ser, Asn, Pro, Gly, Ala, Phe, Cys, Trp, or Asp
  misc_feature (11)..(11): Xaa can be Arg, Lys, Tyr, Leu, Phe, Met, or His
FXAQPPSGQRX

SEQ ID NO: 33959 - protein, 9 aa, Artificial Sequence
  Description of Artificial Sequence: Synthetic peptide
  Seed: FLPVFLAQP (CTG1B_HUMAN)
  misc_feature (2)..(2): Xaa can be Leu, Met, Ile, Val, Thr, Gln, Ala, Ser, Gly, Phe, Asp, Glu, Cys, Trp, Asn, or Pro
  misc_feature (9)..(9): Xaa can be Val, Ile, Ala, Leu, Met, Thr, Cys, Phe, Ser, Gly, Glu, or Pro
FXPVFLAQX

SEQ ID NO: 33960 - protein, 10 aa, Artificial Sequence
  Description of Artificial Sequence: Synthetic peptide
  Seed: FLPVFLAQPP (CTG1B_HUMAN)
  misc_feature (2)..(2): Xaa can be Met, Leu, Arg, Asn, Gly, Lys, Trp, Pro, His, Ala, Thr, Glu, Gln, Ile, Phe, Val, Asp, Ser, Cys, or Tyr
  misc_feature (10)..(10): Xaa can be Cys, Val, Met, Ala, Thr, Gly, Ile, Pro, Ser, Leu, or Phe
FXPVFLAQPX

SEQ ID NO: 33961 - protein, 8 aa, Artificial Sequence
  Description of Artificial Sequence: Synthetic peptide
  Seed: FTVSGNIL (CTG1B_HUMAN)
  misc_feature (2)..(2): Xaa can be Ala, Thr, Ser, Gly, Val, Ile, Met, Phe, Leu, Asn, Tyr, Gln, Glu, Arg, Asp, Pro, Cys, or Hi s
  misc_feature (8)..(8): Xaa can be Leu, Tyr, Phe, Lys, Met, Ile, Val, His, Arg, or Trp
FXVSGNIX

SEQ ID NO: 33962 - protein, 9 aa, Artificial Sequence
  Description of Artificial Sequence: Synthetic peptide
  Seed: FTVSGNILT (CTG1B_HUMAN)
  misc_feature (2)..(2): Xaa can be Leu, Met, Thr, Ile, Ala, Val, Ser, Gln, Cys, Pro, Asn, Gly, Glu, or Phe
  misc_feature (9)..(9): Xaa can be Val, Leu, Ile, Thr, Ala, Met, Cys, Ser, Phe, or Gly
FXVSGNILX

SEQ ID NO: 33963 - protein, 10 aa, Artificial Sequence
  Description of Artificial Sequence: Synthetic peptide
  Seed: FTVSGNILTI (CTG1B_HUMAN)
  misc_feature (2)..(2): Xaa can be Ala, Leu, Met, Ser, Pro, Ile, Val, Thr, Gln, Arg, Cys, Gly, Glu, Asn, Asp, Tyr, His, Phe, Lys, or Trp
  misc_feature (10)..(10): Xaa can be Trp, Tyr, Leu, Val, Ile, Met, Ala, Phe, Lys, Arg, His, Cys, Thr, Ser, Pro, Gly, Gln, or As n
FXVSGNILTX

SEQ ID NO: 33964 - protein, 11 aa, Artificial Sequence
  Description of Artificial Sequence: Synthetic peptide
  Seed: FTVSGNILTIR (CTG1B_HUMAN)
  misc_feature (2)..(2): Xaa can be Ala, Ser, Thr, Val, Gly, Ile, Met, Leu, Asn, Glu, Gln, Phe, Pro, Asp, Tyr, Cys, Lys, Trp, or Arg
  misc_feature (11)..(11): Xaa can be Arg, Lys, Tyr, Leu, Phe, Met, Trp, Ile, or Val
FXVSGNILTIX

SEQ ID NO: 33965 - protein, 9 aa, Artificial Sequence
  Description of Artificial Sequence: Synthetic peptide
  Seed: FYLAMPFAT (CTG1B_HUMAN)
  misc_feature (2)..(2): Xaa can be Tyr, Phe, Trp, Met, Val, Ala, Arg, Ser, His, Thr, Gln, Leu, Ile, Pro, or Gly
  misc_feature (9)..(9): Xaa can be Met, Leu, Tyr, Phe, Val, Ile, Trp, Ala, His, or Thr
FXLAMPFAX

SEQ ID NO: 33966 - protein, 10 aa, Artificial Sequence
  Description of Artificial Sequence: Synthetic peptide
  Seed: FYLAMPFATP (CTG1B_HUMAN)
  misc_feature (2)..(2): Xaa can be Leu, Met, Cys, His, Ile, Thr, Gln, Trp, Pro, Asp, Asn, Ser, Glu, Phe, Val, Gly, Lys, Ala, Tyr, or Arg
  misc_feature (10)..(10): Xaa can be Ser, Phe, Pro, Val, Thr, Gly, Leu, Cys, Ala, Met, Ile, Asp, or Glu
FXLAMPFATX

SEQ ID NO: 33967 - protein, 11 aa, Artificial Sequence
  Description of Artificial Sequence: Synthetic peptide
  Seed: FYLAMPFATPM (CTG1B_HUMAN)
  misc_feature (2)..(2): Xaa can be Leu, Pro, Met, Gln, Tyr, Val, Ile, Thr, Phe, Lys, Trp, Ser, Gly, Arg, Cys, Asn, Glu, Ala, His, or Asp
  misc_feature (11)..(11): Xaa can be Trp, Met, Phe, Tyr, Ile, Ala, Val, His, Leu, Thr, Ser, Cys, Gly, Pro, or Gln
FXLAMPFATPX

SEQ ID NO: 33968 - protein, 11 aa, Artificial Sequence
  Description of Artificial Sequence: Synthetic peptide
  Seed: GAARASGPGGG (CTG1B_HUMAN)
  misc_feature (2)..(2): Xaa can be Gly, Arg, Ala, Gln, Asn, Ser, Pro, Leu, Met, Val, Ile, Asp, Thr, Glu, Cys, His, Lys, Phe, Trp, or Tyr
  misc_feature (11)..(11): Xaa can be Lys, Phe, Arg, Tyr, Asn, His, Leu, Gln, Glu, Met, Gly, Trp, Ala, Pro, Cys, Ile, Thr, Ser, Val, or Asp
GXARASGPGGX

SEQ ID NO: 33969 - protein, 11 aa, Artificial Sequence
  Description of Artificial Sequence: Synthetic peptide
  Seed: GAASGLNGCCR (CTG1B_HUMAN)
  misc_feature (2)..(2): Xaa can be Ala, Val, Ile, Gly, Thr, Ser, Leu, Gln, Met, Asp, Glu, Cys, Asn, Phe, His, Tyr, Pro, Trp, Arg, or Lys
  misc_feature (11)..(11): Xaa can be Lys, Arg, Tyr, Phe, Leu, Met, His, Gln, Ile, or Trp
GXASGLNGCCX

SEQ ID NO: 33970 - protein, 10 aa, Artificial Sequence
  Description of Artificial Sequence: Synthetic peptide
  Seed: GAPRGPHGGA (CTG1B_HUMAN)
  misc_feature (2)..(2): Xaa can be Trp, Tyr, His, Ala, Lys, Met, Arg, Glu, Gln, Asp, Leu, Pro, Gly, Phe, Ser, Asn, Thr, Ile, Cys, or Val
  misc_feature (10)..(10): Xaa can be Phe, Ala, Ile, Leu, Val, or Met
GXPRGPHGGX

SEQ ID NO: 33971 - protein, 11 aa, Artificial Sequence
  Description of Artificial Sequence: Synthetic peptide
  Seed: GAPRGPHGGAA (CTG1B_HUMAN)
  misc_feature (2)..(2): Xaa can be Pro, Arg, Tyr, Trp, Val, Leu, Lys, His, Ser, Met, Ala, Ile, Phe, Thr, Asn, Cys, Gly, Gln, or Glu
  misc_feature (11)..(11): Xaa can be Leu, Val, Met, Ile, Phe, Ala, Thr, Cys, Trp, Pro, Ser, Gly, Tyr, Lys, or Arg
GXPRGPHGGAX

SEQ ID NO: 33972 - protein, 9 aa, Artificial Sequence
  Description of Artificial Sequence: Synthetic peptide
  Seed: GARGPESRL (CTG1B_HUMAN)
  misc_feature (2)..(2): Xaa can be Pro, Ala, Gln, Thr, Ser, Arg, Ile, Leu, Val, Met, Gly, Glu, Asn, His, Lys, Phe, Cys, Trp, Tyr, or Asp
  misc_feature (9)..(9): Xaa can be Tyr, Phe, Leu, Met, Ile, Val, His, Trp, Ala, Pro, Thr, Ser, or Cys
GXRGPESRX

SEQ ID NO: 33973 - protein, 10 aa, Artificial Sequence
  Description of Artificial Sequence: Synthetic peptide
  Seed: GARGPESRLL (CTG1B_HUMAN)
  misc_feature (2)..(2): Xaa can be Ala, Ser, Val, Thr, Gln, Ile, Leu, Met, Glu, or Gly
  misc_feature (10)..(10): Xaa can be Tyr, Phe, Met, Leu, or His
GXRGPESRLX

SEQ ID NO: 33974 - protein, 9 aa, Artificial Sequence
  Description of Artificial Sequence: Synthetic peptide
  Seed: GATGGRGPR (CTG1B_HUMAN)
  misc_feature (2)..(2): Xaa can be Ala, Ser, Thr, Val, Leu, Met, Gly, Ile, Tyr, Asn, Phe, Pro, Trp, or Gln
  misc_feature (9)..(9): Xaa can be Arg, Lys, Tyr, Leu, Met, Phe, Ile, or Val
GXTGGRGPX

SEQ ID NO: 33975 - protein, 11 aa, Artificial Sequence
  Description of Artificial Sequence: Synthetic peptide
  Seed: GDADGPGGPGI (CTG1B_HUMAN)
  misc_feature (2)..(2): Xaa can be Asn, Asp, Pro, Glu, Arg, Ala, Gly, Gln, Met, Ser, Val, Ile, Leu, Thr, Trp, Phe, Cys, Lys, His, or Tyr
  misc_feature (11)..(11): Xaa can be Gly, Lys, Arg, Glu, Tyr, Gln, Met, Asn, Leu, His, Phe, Trp, Ser, Asp, Ile, Cys, Ala, Pro, Val, or Thr
GXADGPGGPGX

SEQ ID NO: 33976 - protein, 9 aa, Artificial Sequence
  Description of Artificial Sequence: Synthetic peptide
  Seed: GEAGATGGR (CTG1B_HUMAN)
  misc_feature (2)..(2): Xaa can be Ala, Glu, Gln, Val, Thr, Asp, Ser, Asn, Met, Cys, Pro, Leu, Phe, Gly, Ile, or Tyr
  misc_feature (9)..(9): Xaa can be Lys, Arg, Met, Tyr, Leu, Phe, Trp, His, Val, or Ile
GXAGATGGX

SEQ ID NO: 33977 - protein, 10 aa, Artificial Sequence
  Description of Artificial Sequence: Synthetic peptide
  Seed: GEAGATGGRG (CTG1B_HUMAN)
  misc_feature (2)..(2): Xaa can be Glu, or Asp
  misc_feature (10)..(10): Xaa can be Ile, Val, Ala, Cys, Leu, Ser, Tyr, Gly, Phe, Pro, Thr, or Met
GXAGATGGRX

SEQ ID NO: 33978 - protein, 11 aa, Artificial Sequence
  Description of Artificial Sequence: Synthetic peptide
  Seed: GEAGATGGRGP (CTG1B_HUMAN)
  misc_feature (2)..(2): Xaa can be Glu, Asp, or Gln
  misc_feature (11)..(11): Xaa can be Leu, Cys, Ala, Ile, Met, Phe, Val, Thr, Gly, Trp, Pro, Tyr, or Ser
GXAGATGGRGX

SEQ ID NO: 33979 - protein, 11 aa, Artificial Sequence
  Description of Artificial Sequence: Synthetic peptide
  Seed: GGAPRGPHGGA (CTG1B_HUMAN)
  misc_feature (2)..(2): Xaa can be Gly, Arg, Ser, Asn, Gln, Ala, Pro, Asp, Ile, Val, Thr, Glu, Leu, His, Met, Lys, Cys, or Ph e
  misc_feature (11)..(11): Xaa can be Phe, Tyr, Lys, Arg, Asn, Leu, His, Gln, Glu, Met, Ala, Ile, Cys, Val, Gly, Trp, Pro, Asp, or Ser
GXAPRGPHGGX

SEQ ID NO: 33980 - protein, 9 aa, Artificial Sequence
  Description of Artificial Sequence: Synthetic peptide
  Seed: GGGAPRGPH (CTG1B_HUMAN)
  misc_feature (2)..(2): Xaa can be Arg, Gly, Ala, Gln, Lys, or Pro
  misc_feature (9)..(9): Xaa can be Lys, Arg, Leu, His, Tyr, Phe, Asn, Gln, Met, Trp, Ile, Ala, or Val
GXGAPRGPX

SEQ ID NO: 33981 - protein, 11 aa, Artificial Sequence
  Description of Artificial Sequence: Synthetic peptide
  Seed: GGGAPRGPHGG (CTG1B_HUMAN)
  misc_feature (2)..(2): Xaa can be Gly, Arg, Ala, Asn, Gln, Ser, Ile, Pro, Val, Leu, Asp, Lys, Thr, His, Met, Glu, Cys, Phe, or Trp
  misc_feature (11)..(11): Xaa can be Lys, Phe, Arg, Asn, Leu, Glu, Tyr, His, Gln, Met, Ile, Ala, Gly, Cys, Pro, Trp, Ser, Val, Thr, or Asp
GXGAPRGPHGX

SEQ ID NO: 33982 - protein, 9 aa, Artificial Sequence
  Description of Artificial Sequence: Synthetic peptide
  Seed: GGNAGGPGE (CTG1B_HUMAN)
  misc_feature (2)..(2): Xaa can be Arg, Gly, Gln, Ala, Asn, Lys, Leu, Met, Ile, Ser, Pro, Glu, His, Phe, or Val
  misc_feature (9)..(9): Xaa can be Lys, Leu, Arg, Phe, Tyr, His, Met, Gln, Ile, Glu, Asn, Thr, Ala, Trp, Gly, Val, Pro, or Cy s
GXNAGGPGX

SEQ ID NO: 33983 - protein, 10 aa, Artificial Sequence
  Description of Artificial Sequence: Synthetic peptide
  Seed: GGNAGGPGEA (CTG1B_HUMAN)
  misc_feature (2)..(2): Xaa can be Gly, Arg, Ala, Ile, Gln, Pro, Asn, Val, Thr, Leu, Met, Ser, His, Lys, Asp, Phe, Glu, Tyr, Cys, or Trp
  misc_feature (10)..(10): Xaa can be Phe, Lys, Arg, Tyr, Leu, Met, His, Asn, Gln, Glu, Ala, Gly, Ile, Trp, Val, Ser, Pro, Asp, Cys, or Thr
GXNAGGPGEX

SEQ ID NO: 33984 - protein, 11 aa, Artificial Sequence
  Description of Artificial Sequence: Synthetic peptide
  Seed: GGNAGGPGEAG (CTG1B_HUMAN)
  misc_feature (2)..(2): Xaa can be Arg, Gly, Ala, Ser, Asn, Ile, Val, Thr, Pro, Met, Gln, Leu, Asp, Glu, Cys, Phe, Trp, Tyr, His, or Lys
  misc_feature (11)..(11): Xaa can be Arg, Gln, Glu, Phe, Asn, Lys, Met, His, Leu, Tyr, Gly, Trp, Ile, Asp, Cys, Ser, Val, Pro, Ala, or Thr
GXNAGGPGEAX

SEQ ID NO: 33985 - protein, 10 aa, Artificial Sequence
  Description of Artificial Sequence: Synthetic peptide
  Seed: GGPGEAGATG (CTG1B_HUMAN)
  misc_feature (2)..(2): Xaa can be Gly, Arg, Pro, Ala, Ile, Gln, Asn, Val, Met, Ser, Leu, Thr, Asp, His, Lys, or Glu
  misc_feature (10)..(10): Xaa can be Lys, Phe, Arg, Tyr, Leu, His, Asn, Gln, Met, Gly, Val, Trp, Glu, or Ile
GXPGEAGATX

SEQ ID NO: 33986 - protein, 11 aa, Artificial Sequence
  Description of Artificial Sequence: Synthetic peptide
  Seed: GGPGEAGATGG (CTG1B_HUMAN)
  misc_feature (2)..(2): Xaa can be Gly, Arg, Ala, Ile, Gln, Asn, Pro, Val, Ser, Met, Leu, Asp, Cys, Thr, Glu, His, Lys, Phe, Tyr, or Trp
  misc_feature (11)..(11): Xaa can be Lys, Phe, Arg, Tyr, Asn, Glu, His, Gln, Leu, Met, Gly, Val, Cys, Ala, Asp, Trp, Ile, Ser, or Pro
GXPGEAGATGX

SEQ ID NO: 33987 - protein, 11 aa, Artificial Sequence
  Description of Artificial Sequence: Synthetic peptide
  Seed: GGPGIPDGPGG (CTG1B_HUMAN)
  misc_feature (2)..(2): Xaa can be Gly, Arg, Ala, Val, Asn, Leu, Ile, Gln, Pro, Ser, Met, Thr, Asp, His, Cys, Glu, Lys, Phe, Trp, or Tyr
  misc_feature (11)..(11): Xaa can be Phe, Lys, Arg, Tyr, Asn, His, Glu, Gln, Leu, Met, Gly, Pro, Trp, Cys, Asp, Ile, Val, Ala, Ser, or Thr
GXPGIPDGPGX

SEQ ID NO: 33988 - protein, 11 aa, Artificial Sequence
  Description of Artificial Sequence: Synthetic peptide
  Seed: GGRGPRGAGAA (CTG1B_HUMAN)
  misc_feature (2)..(2): Xaa can be Pro, Ala, Val, or Gly
  misc_feature (11)..(11): Xaa can be Ala, Cys, Val, Leu, Met, Phe, Gly, Tyr, Asn, Arg, Thr, Glu, Ser, Lys, Trp, Ile, Asp, Gln, His, or Pro
GXRGPRGAGAX

SEQ ID NO: 33989 - protein, 11 aa, Artificial Sequence
  Description of Artificial Sequence: Synthetic peptide
  Seed: GGSTGDADGPG (CTG1B_HUMAN)
  misc_feature (2)..(2): Xaa can be Gly, Arg, Ala, Gln, Pro, Asn, Ser, Ile, Val, Met, Leu, His, Asp, Glu, Tyr, Lys, Thr, Trp, Phe, or Cys
  misc_feature (11)..(11): Xaa can be Lys, Arg, Phe, Tyr, His, Asn, Gln, Glu, Leu, Trp, Met, Ile, Ser, Asp, or Gly
GXSTGDADGPX

SEQ ID NO: 33990 - protein, 10 aa, Artificial Sequence
  Description of Artificial Sequence: Synthetic peptide
  Seed: GIPDGPGGNA (CTG1B_HUMAN)
  misc_feature (2)..(2): Xaa can be Ala, Leu, Ser, Val, Met, Thr, Ile, Gln, Gly, Phe, Asn, Tyr, Pro, Cys, Glu, Trp, His, Lys, Arg, or Asp
  misc_feature (10)..(10): Xaa can be Tyr, Met, Phe, Lys, Leu, Arg, Ile, Val, Trp, His, Ala, Cys, Gln, Thr, or Ser
GXPDGPGGNX

SEQ ID NO: 33991 - protein, 11 aa, Artificial Sequence
  Description of Artificial Sequence: Synthetic peptide
  Seed: GIPDGPGGNAG (CTG1B_HUMAN)
  misc_feature (2)..(2): Xaa can be Pro, Val, Arg, Gly, Ile, Ala, Leu, Gln, Met, Asn, Ser, Thr, Phe, Trp, Cys, Asp, Glu, Tyr, Lys, or His
  misc_feature (11)..(11): Xaa can be Tyr, His, Leu, Gly, Met, Glu, Arg, Asn, Lys, Gln, Trp, Phe, Asp, Ser, Ile, Cys, Ala, Pro, Val, or Thr
GXPDGPGGNAX

SEQ ID NO: 33992 - protein, 10 aa, Artificial Sequence
  Description of Artificial Sequence: Synthetic peptide
  Seed: GLNGCCRCGA (CTG1B_HUMAN)
  misc_feature (2)..(2): Xaa can be Leu, Met, Val, or Ile
  misc_feature (10)..(10): Xaa can be Val, Leu, Ile, Ala, or Met
GXNGCCRCGX

SEQ ID NO: 33993 - protein, 11 aa, Artificial Sequence
  Description of Artificial Sequence: Synthetic peptide
  Seed: GNAGGPGEAGA (CTG1B_HUMAN)
  misc_feature (2)..(2): Xaa can be Arg, Gly, Ala, Asn, Ile, Gln, Ser, Val, Pro, Leu, Met, Thr, Asp, Cys, Glu, His, Lys, Trp, Phe, or Tyr
  misc_feature (11)..(11): Xaa can be Tyr, Asn, Gln, His, Arg, Leu, Lys, Phe, Glu, Met, Gly, Trp, Ile, Asp, Ser, Cys, Pro, Ala, Val, or Thr
GXAGGPGEAGX

SEQ ID NO: 33994 - protein, 9 aa, Artificial Sequence
  Description of Artificial Sequence: Synthetic peptide
  Seed: GPESRLLEF (CTG1B_HUMAN)
  misc_feature (2)..(2): Xaa can be Pro, Ala, Phe, Leu, Gln, Tyr, Met, Ile, Val, Ser, Glu, Trp, Thr, Asp, or Gly
  misc_feature (9)..(9): Xaa can be Tyr, Phe, Leu, Met, Trp, Pro, Val, Ile, Thr, Cys, Ala, or Ser
GXESRLLEX

SEQ ID NO: 33995 - protein, 10 aa, Artificial Sequence
  Description of Artificial Sequence: Synthetic peptide
  Seed: GPESRLLEFY (CTG1B_HUMAN)
  misc_feature (2)..(2): Xaa can be Ala, Gly, Lys, Pro, Arg, Ile, Phe, Thr, Trp, Val, Met, Asp, Glu, Cys, Tyr, Asn, Leu, His, Gln, or Ser
  misc_feature (10)..(10): Xaa can be Phe, Trp, or Tyr
GXESRLLEFX

SEQ ID NO: 33996 - protein, 9 aa, Artificial Sequence
  Description of Artificial Sequence: Synthetic peptide
  Seed: GPGEAGATG (CTG1B_HUMAN)
  misc_feature (2)..(2): Xaa can be Pro, Val, or Ala
  misc_feature (9)..(9): Xaa can be Ala, Ile, Pro, Gly, Cys, Arg, Met, Phe, Leu, Tyr, Thr, Val, or Ser
GXGEAGATX

SEQ ID NO: 33997 - protein, 10 aa, Artificial Sequence
  Description of Artificial Sequence: Synthetic peptide
  Seed: GPGEAGATGG (CTG1B_HUMAN)
  misc_feature (2)..(2): Xaa can be , or Pro
  misc_feature (10)..(10): Xaa can be Ser, Ala, Phe, Leu, Ile, Met, Cys, Thr, Gly, Pro, or Val
GXGEAGATGX

SEQ ID NO: 33998 - protein, 11 aa, Artificial Sequence
  Description of Artificial Sequence: Synthetic peptide
  Seed: GPGEAGATGGR (CTG1B_HUMAN)
  misc_feature (2)..(2): Xaa can be Arg, Gly, Pro, Ala, Val, Ile, Ser, Asn, Thr, Gln, Cys, Leu, Phe, Trp, Asp, Met, Glu, His, Lys, or Tyr
  misc_feature (11)..(11): Xaa can be Phe, Arg, His, Lys, Tyr, Asn, Leu, Glu, Gln, Met, Trp, Gly, Ile, Cys, Ala, Val, Pro, Asp, Ser, or Thr
GXGEAGATGGX

SEQ ID NO: 33999 - protein, 10 aa, Artificial Sequence
  Description of Artificial Sequence: Synthetic peptide
  Seed: GPGGGAPRGP (CTG1B_HUMAN)
  misc_feature (2)..(2): Xaa can be , or Pro
  misc_feature (10)..(10): Xaa can be Met, Leu, Ser, Tyr, Val, Pro, Ala, Thr, Phe, Ile, Gly, or Cys
GXGGGAPRGX

SEQ ID NO: 34000 - protein, 11 aa, Artificial Sequence
  Description of Artificial Sequence: Synthetic peptide
  Seed: GPGGGAPRGPH (CTG1B_HUMAN)
  misc_feature (2)..(2): Xaa can be Gly, Arg, Ala, Gln, Ser, Val, Asn, Ile, Met, Thr, Asp, Pro, Leu, Glu, Cys, His, Phe, Lys, Tyr, or Trp
  misc_feature (11)..(11): Xaa can be Lys, Arg, Phe, Asn, Tyr, His, Glu, Gln, Leu, Met, Gly, Trp, Ile, Val, Ala, Pro, Asp, Ser, Cys, or Thr
GXGGGAPRGPX

SEQ ID NO: 34001 - protein, 10 aa, Artificial Sequence
  Description of Artificial Sequence: Synthetic peptide
  Seed: GPGGNAGGPG (CTG1B_HUMAN)
  misc_feature (2)..(2): Xaa can be , or Pro
  misc_feature (10)..(10): Xaa can be Phe, Thr, Ala, Ile, Leu, Met, Cys, Tyr, Ser, Gly, Pro, or Val
GXGGNAGGPX

SEQ ID NO: 34002 - protein, 11 aa, Artificial Sequence
  Description of Artificial Sequence: Synthetic peptide
  Seed: GPGGNAGGPGE (CTG1B_HUMAN)
  misc_feature (2)..(2): Xaa can be Ala, Arg, Pro, Gly, Val, Ile, Ser, Asn, Gln, Leu, Thr, Met, Cys, Phe, Asp, Glu, Trp, His, Lys, or Tyr
  misc_feature (11)..(11): Xaa can be His, Gln, Arg, Phe, Lys, Tyr, Glu, Leu, Asn, Met, Gly, Asp, Trp, Cys, Ile, Ser, Ala, Pro, Val, or Thr
GXGGNAGGPGX

SEQ ID NO: 34003 - protein, 10 aa, Artificial Sequence
  Description of Artificial Sequence: Synthetic peptide
  Seed: GPGGPGIPDG (CTG1B_HUMAN)
  misc_feature (2)..(2): Xaa can be , or Pro
  misc_feature (10)..(10): Xaa can be Cys, Gly, Met, Thr, Arg, Tyr, Leu, Ala, Ile, Phe, Ser, Pro, or Val
GXGGPGIPDX

SEQ ID NO: 34004 - protein, 11 aa, Artificial Sequence
  Description of Artificial Sequence: Synthetic peptide
  Seed: GPGGPGIPDGP (CTG1B_HUMAN)
  misc_feature (2)..(2): Xaa can be Pro, or Ala
  misc_feature (11)..(11): Xaa can be Leu, Cys, Trp, Ser, Pro, Phe, Met, Val, Thr, Arg, Ile, Tyr, Lys, Ala, or Gly
GXGGPGIPDGX

SEQ ID NO: 34005 - protein, 10 aa, Artificial Sequence
  Description of Artificial Sequence: Synthetic peptide
  Seed: GPGIPDGPGG (CTG1B_HUMAN)
  misc_feature (2)..(2): Xaa can be , or Pro
  misc_feature (10)..(10): Xaa can be Arg, Gly, Pro, Ile, Leu, Cys, Ala, Ser, Val, Met, Phe, or Thr
GXGIPDGPGX

SEQ ID NO: 34006 - protein, 11 aa, Artificial Sequence
  Description of Artificial Sequence: Synthetic peptide
  Seed: GPGIPDGPGGN (CTG1B_HUMAN)
  misc_feature (2)..(2): Xaa can be Gly, Ala, Arg, Asn, Val, Gln, Ile, Ser, Met, Pro, Thr, Leu, Phe, Trp, Cys, Asp, His, Tyr, Lys, or Glu
  misc_feature (11)..(11): Xaa can be Met, Leu, Tyr, Phe, Glu, Arg, His, Lys, Gln, Asn, Gly, Trp, Asp, Ser, Ile, Cys, Pro, Ala, Val, or Thr
GXGIPDGPGGX

SEQ ID NO: 34007 - protein, 9 aa, Artificial Sequence
  Description of Artificial Sequence: Synthetic peptide
  Seed: GPHGGAASG (CTG1B_HUMAN)
  misc_feature (2)..(2): Xaa can be Pro, Ala, Val, Ile, Ser, or Gly
  misc_feature (9)..(9): Xaa can be Ala, Met, Leu, Ile, Pro, Phe, Cys, Val, Asn, Thr, His, Tyr, Gln, Arg, Trp, Ser, Lys, Gly, or Glu
GXHGGAASX

SEQ ID NO: 34008 - protein, 10 aa, Artificial Sequence
  Description of Artificial Sequence: Synthetic peptide
  Seed: GPHGGAASGL (CTG1B_HUMAN)
  misc_feature (2)..(2): Xaa can be Pro, Ala, Ser, Thr, or Val
  misc_feature (10)..(10): Xaa can be Leu, Met, Val, Ile, Tyr, Phe, Ala, Ser, Arg, Pro, Thr, Trp, Cys, Lys, or Gly
GXHGGAASGX

SEQ ID NO: 34009 - protein, 8 aa, Artificial Sequence
  Description of Artificial Sequence: Synthetic peptide
  Seed: GPRGAGAA (CTG1B_HUMAN)
  misc_feature (2)..(2): Xaa can be , or Pro
  misc_feature (8)..(8): Xaa can be Pro, Met, Phe, Val, Ile, Ala, or Leu
GXRGAGAX

SEQ ID NO: 34010 - protein, 9 aa, Artificial Sequence
  Description of Artificial Sequence: Synthetic peptide
  Seed: GPRGAGAAR (CTG1B_HUMAN)
  misc_feature (2)..(2): Xaa can be Pro, Ala, Val, Ile, Ser, Thr, Gly, Leu, Met, Cys, Gln, Tyr, Phe, Asn, Asp, Glu, or Trp
  misc_feature (9)..(9): Xaa can be Arg, Leu, Ala, Met, Ile, Lys, Val, Phe, Cys, Ser, Tyr, Thr, Pro, Gly, Gln, Asp, His, Glu, Trp, or Asn
GXRGAGAAX

SEQ ID NO: 34011 - protein, 10 aa, Artificial Sequence
  Description of Artificial Sequence: Synthetic peptide
  Seed: GPRGAGAARA (CTG1B_HUMAN)
  misc_feature (2)..(2): Xaa can be Pro, Ala, Val, Ile, Leu, Thr, or Met
  misc_feature (10)..(10): Xaa can be Leu, Met, Tyr, Ala, Phe, Cys, Ser, Pro, Trp, Thr, Gly, Ile, or Val
GXRGAGAARX

SEQ ID NO: 34012 - protein, 11 aa, Artificial Sequence
  Description of Artificial Sequence: Synthetic peptide
  Seed: GPRGAGAARAS (CTG1B_HUMAN)
  misc_feature (2)..(2): Xaa can be Pro, Ala, or Val
  misc_feature (11)..(11): Xaa can be Ala, Met, Leu, Cys, Phe, Glu, Trp, Ile, Lys, Gln, His, Val, Gly, Tyr, Ser, Asn, Thr, Pro, or Arg
GXRGAGAARAX

SEQ ID NO: 34013 - protein, 9 aa, Artificial Sequence
  Description of Artificial Sequence: Synthetic peptide
  Seed: GRGPRGAGA (CTG1B_HUMAN)
  misc_feature (2)..(2): Xaa can be Arg, Gly, Gln, His, Ala, Ser, Phe, Glu, Tyr, Met, Asn, Asp, Ile, Trp, Lys, Val, Leu, Pro, or Thr
  misc_feature (9)..(9): Xaa can be Leu, Phe, Met, Lys, Tyr, Val, Ile, Arg, Ala, His, Thr, Cys, Pro, Gln, Trp, Glu, or Asn
GXGPRGAGX

SEQ ID NO: 34014 - protein, 10 aa, Artificial Sequence
  Description of Artificial Sequence: Synthetic peptide
  Seed: GRGPRGAGAA (CTG1B_HUMAN)
  misc_feature (2)..(2): Xaa can be Arg, or Gln
  misc_feature (10)..(10): Xaa can be Met, Phe, Leu, Thr, Tyr, Ile, Trp, Cys, Val, or Ala
GXGPRGAGAX

SEQ ID NO: 34015 - protein, 11 aa, Artificial Sequence
  Description of Artificial Sequence: Synthetic peptide
  Seed: GRGPRGAGAAR (CTG1B_HUMAN)
  misc_feature (2)..(2): Xaa can be Gly, Arg, Ala, Gln, Pro, Val, Ser, Ile, Thr, Asn, Leu, His, Asp, Tyr, Glu, Met, Lys, Cys, Phe, or Trp
  misc_feature (11)..(11): Xaa can be Tyr, Phe, Lys, Leu, Met, Arg, His, Asn, Glu, Gln, Trp, Ile, Val, Gly, Ser, Asp, Cys, Thr, Pro, or Ala
GXGPRGAGAAX

SEQ ID NO: 34016 - protein, 9 aa, Artificial Sequence
  Description of Artificial Sequence: Synthetic peptide
  Seed: GVLLKEFTV (CTG1B_HUMAN)
  misc_feature (2)..(2): Xaa can be Gln, Leu, Met, Ile, Glu, Thr, Ser, Val, Ala, Asn, Gly, or Asp
  misc_feature (9)..(9): Xaa can be Val, Ile, Leu, Met, Ala, Cys, Thr, Phe, Trp, or Tyr
GXLLKEFTX

SEQ ID NO: 34017 - protein, 10 aa, Artificial Sequence
  Description of Artificial Sequence: Synthetic peptide
  Seed: HGGAASGLNG (CTG1B_HUMAN)
  misc_feature (2)..(2): Xaa can be Gly, Arg, Ala, Ile, Leu, Met, Pro, Asn, Gln, Ser, Val, Thr, Phe, Lys, Cys, Asp, Glu, His, Trp, or Tyr
  misc_feature (10)..(10): Xaa can be Phe, Lys, Leu, Tyr, Met, Arg, Ile, Asn, His, Gln, Glu, Val, Ser, Trp, Asp, Gly, or Ala
HXGAASGLNX

SEQ ID NO: 34018 - protein, 11 aa, Artificial Sequence
  Description of Artificial Sequence: Synthetic peptide
  Seed: HGGAASGLNGC (CTG1B_HUMAN)
  misc_feature (2)..(2): Xaa can be Gly, Arg, Ala, Val, Ile, Asn, Ser, Gln, Met, Leu, Asp, Pro, Cys, Thr, Glu, Phe, Trp, Lys, His, or Tyr
  misc_feature (11)..(11): Xaa can be Phe, Lys, Tyr, Leu, Asn, Glu, Arg, Met, Gln, His, Ile, Gly, Asp, Trp, Cys, Val, Ser, Ala, Thr, or Pro
HXGAASGLNGX

SEQ ID NO: 34019 - protein, 8 aa, Artificial Sequence
  Description of Artificial Sequence: Synthetic peptide
  Seed: HRQLQLSI (CTG1B_HUMAN)
  misc_feature (2)..(2): Xaa can be His, Arg, Gln, Glu, Asn, Asp, Thr, Ala, Phe, Gly, Lys, Ser, Tyr, or Pro
  misc_feature (8)..(8): Xaa can be Leu, Met, Ile, Phe, Ala, Val, Pro, Ser, Thr, or Cys
HXQLQLSX

SEQ ID NO: 34020 - protein, 9 aa, Artificial Sequence
  Description of Artificial Sequence: Synthetic peptide
  Seed: HRQLQLSIS (CTG1B_HUMAN)
  misc_feature (2)..(2): Xaa can be Arg, His, or Gln
  misc_feature (9)..(9): Xaa can be Leu, Ala, Pro, Ile, Met, Thr, Cys, Ser, Val, or Gly
HXQLQLSIX

SEQ ID NO: 34021 - protein, 11 aa, Artificial Sequence
  Description of Artificial Sequence: Synthetic peptide
  Seed: HRQLQLSISSC (CTG1B_HUMAN)
  misc_feature (2)..(2): Xaa can be , or Arg
  misc_feature (11)..(11): Xaa can be Cys, or Ala
HXQLQLSISSX

SEQ ID NO: 34022 - protein, 9 aa, Artificial Sequence
  Description of Artificial Sequence: Synthetic peptide
  Seed: ILTIRLTAA (CTG1B_HUMAN)
  misc_feature (2)..(2): Xaa can be Pro, Leu, Met, Ala, Ile, Val, Gln, Gly, Phe, Ser, Thr, Asn, Asp, Cys, Arg, Tyr, Trp, Glu, His, or Lys
  misc_feature (9)..(9): Xaa can be Leu, Met, Ile, Val, Phe, Ala, Cys, or Thr
IXTIRLTAX

SEQ ID NO: 34023 - protein, 9 aa, Artificial Sequence
  Description of Artificial Sequence: Synthetic peptide
  Seed: IPDGPGGNA (CTG1B_HUMAN)
  misc_feature (2)..(2): Xaa can be Ala, Pro, Ser, Thr, Gly, Val, Met, Phe, Leu, Ile, Gln, Tyr, Cys, Trp, Asn, Asp, Glu, His, Arg, or Lys
  misc_feature (9)..(9): Xaa can be Met, Leu, Phe, Val, Ile, Tyr, Ala, Cys, Trp, Thr, Ser, Pro, Gly, Lys, Arg, Gln, or His
IXDGPGGNX

SEQ ID NO: 34024 - protein, 10 aa, Artificial Sequence
  Description of Artificial Sequence: Synthetic peptide
  Seed: IPDGPGGNAG (CTG1B_HUMAN)
  misc_feature (2)..(2): Xaa can be Pro, Ala, Val, Ile, Met, Thr, Ser, Phe, Tyr, Gly, Leu, Trp, Cys, Gln, Glu, Asp, Asn, or Hi s
  misc_feature (10)..(10): Xaa can be Tyr, Phe, Met, Leu, Trp, Ile, Val, Ala, Cys, His, Gln, Ser, Asn, Thr, Pro, Lys, Glu, Arg, or Gly
IXDGPGGNAX

SEQ ID NO: 34025 - protein, 11 aa, Artificial Sequence
  Description of Artificial Sequence: Synthetic peptide
  Seed: IPDGPGGNAGG (CTG1B_HUMAN)
  misc_feature (2)..(2): Xaa can be Gly, Arg, Pro, Ala, Trp, Gln, Phe, Met, Val, Tyr, Ile, Leu, Ser, Asn, Thr, Glu, Asp, His, Lys, or Cys
  misc_feature (11)..(11): Xaa can be Met, Leu, Lys, Tyr, Phe, Arg, Asn, His, Glu, Gln, Trp, Ile, Gly, Val, Cys, Ala, Asp, Pro, Ser, or Thr
IXDGPGGNAGX

SEQ ID NO: 34026 - protein, 9 aa, Artificial Sequence
  Description of Artificial Sequence: Synthetic peptide
  Seed: IRLTAADHR (CTG1B_HUMAN)
  misc_feature (2)..(2): Xaa can be , or Arg
  misc_feature (9)..(9): Xaa can be Phe, Met, Ile, Arg, Tyr, Lys, or Leu
IXLTAADHX

SEQ ID NO: 34027 - protein, 11 aa, Artificial Sequence
  Description of Artificial Sequence: Synthetic peptide
  Seed: IRLTAADHRQL (CTG1B_HUMAN)
  misc_feature (2)..(2): Xaa can be Arg, or Tyr
  misc_feature (11)..(11): Xaa can be Phe, Trp, Leu, Lys, Ile, Tyr, Arg, or Met
IXLTAADHRQX

SEQ ID NO: 34028 - protein, 8 aa, Artificial Sequence
  Description of Artificial Sequence: Synthetic peptide
  Seed: ISSCLQQL (CTG1B_HUMAN)
  misc_feature (2)..(2): Xaa can be Ala, Gln, Thr, Ser, Val, Gly, Ile, Met, Glu, Leu, Arg, Cys, Pro, Asp, Asn, or Phe
  misc_feature (8)..(8): Xaa can be Trp, Leu, Ile, Val, Tyr, Met, Phe, Lys, Arg, or His
IXSCLQQX

SEQ ID NO: 34029 - protein, 10 aa, Artificial Sequence
  Description of Artificial Sequence: Synthetic peptide
  Seed: ISSCLQQLSL (CTG1B_HUMAN)
  misc_feature (2)..(2): Xaa can be Arg, Gln, Thr, Ser, Ala, Met, Gly, Asn, Ile, Leu, Val, His, Lys, Glu, Asp, Tyr, Trp, Cys, Phe, or Pro
  misc_feature (10)..(10): Xaa can be Leu, Tyr, Phe, Trp, Ile, Met, Val, Lys, or Arg
IXSCLQQLSX

SEQ ID NO: 34030 - protein, 11 aa, Artificial Sequence
  Description of Artificial Sequence: Synthetic peptide
  Seed: ISSCLQQLSLL (CTG1B_HUMAN)
  misc_feature (2)..(2): Xaa can be Thr, Ser, Ala, Met, Val, Cys, Gly, Ile, Arg, Pro, Leu, Gln, Asn, Asp, or Tyr
  misc_feature (11)..(11): Xaa can be Trp, Phe, Tyr, Leu, Ile, or Met
IXSCLQQLSLX

SEQ ID NO: 34031 - protein, 9 aa, Artificial Sequence
  Description of Artificial Sequence: Synthetic peptide
  Seed: ITQCFLPVF (CTG1B_HUMAN)
  misc_feature (2)..(2): Xaa can be Gln, Met, Ala, Ser, Thr, Val, Tyr, Leu, Trp, Ile, Lys, Asn, Gly, Phe, Pro, His, Cys, Glu, Arg, or Asp
  misc_feature (9)..(9): Xaa can be Tyr, Phe, Leu, Trp, Met, Ile, Val, His, Ala, Gly, or Cys
IXQCFLPVX

SEQ ID NO: 34032 - protein, 10 aa, Artificial Sequence
  Description of Artificial Sequence: Synthetic peptide
  Seed: ITQCFLPVFL (CTG1B_HUMAN)
  misc_feature (2)..(2): Xaa can be Leu, Met, Thr, Ser, Val, Ile, Gln, Ala, Phe, Gly, Cys, Tyr, Pro, Asn, Lys, Glu, Trp, Asp, His, or Arg
  misc_feature (10)..(10): Xaa can be Val, Trp, Leu, Ile, Met, Ala, Phe, Tyr, Thr, Cys, or Ser
IXQCFLPVFX

SEQ ID NO: 34033 - protein, 9 aa, Artificial Sequence
  Description of Artificial Sequence: Synthetic peptide
  Seed: KEFTVSGNI (CTG1B_HUMAN)
  misc_feature (2)..(2): Xaa can be Glu, Gln, Asp, Met, Ile, Leu, Val, Ala, Thr, Ser, or Asn
  misc_feature (9)..(9): Xaa can be Val, Phe, Leu, Ile, Trp, Met, Tyr, Cys, Ala, Thr, Lys, Gly, Arg, Ser, Pro, or His
KXFTVSGNX

SEQ ID NO: 34034 - protein, 10 aa, Artificial Sequence
  Description of Artificial Sequence: Synthetic peptide
  Seed: KEFTVSGNIL (CTG1B_HUMAN)
  misc_feature (2)..(2): Xaa can be Glu, Gln, Asp, His, Arg, Met, Val, Ser, Ile, Leu, Thr, Ala, Lys, Tyr, Asn, Gly, Phe, Trp, Cys, or Pro
  misc_feature (10)..(10): Xaa can be Tyr, Phe, Met, Trp, Leu, Ile, Val, Cys, His, Ala, Lys, Arg, Thr, Asp, Gln, Glu, Ser, Asn, Pro, or Gly
KXFTVSGNIX

SEQ ID NO: 34035 - protein, 11 aa, Artificial Sequence
  Description of Artificial Sequence: Synthetic peptide
  Seed: KEFTVSGNILT (CTG1B_HUMAN)
  misc_feature (2)..(2): Xaa can be Glu, or Asp
  misc_feature (11)..(11): Xaa can be Cys, Leu, Phe, Ala, Thr, Gly, Met, Ser, Pro, Tyr, Trp, Val, or Ile
KXFTVSGNILX

SEQ ID NO: 34036 - protein, 9 aa, Artificial Sequence
  Description of Artificial Sequence: Synthetic peptide
  Seed: LAMPFATPM (CTG1B_HUMAN)
  misc_feature (2)..(2): Xaa can be Gln, Pro, Met, Tyr, Ala, Leu, Lys, Ser, Phe, Val, Arg, Thr, His, Ile, Gly, Asn, Trp, Glu, Cys, or Asp
  misc_feature (9)..(9): Xaa can be Tyr, Ile, Trp, Phe, Arg, Val, Met, Leu, His, Lys, Ala, Thr, Cys, Ser, Gly, Gln, Asn, Pro, Glu, or Asp
LXMPFATPX

SEQ ID NO: 34037 - protein, 10 aa, Artificial Sequence
  Description of Artificial Sequence: Synthetic peptide
  Seed: LAMPFATPME (CTG1B_HUMAN)
  misc_feature (2)..(2): Xaa can be Ala, Ser, Thr, Val, Met, Gln, Leu, Ile, or Gly
  misc_feature (10)..(10): Xaa can be Phe, Tyr, Met, Leu, Ile, Val, His, Trp, Gln, Gly, Cys, Pro, Asp, Thr, Ser, Arg, Glu, Asn, Lys, or Ala
LXMPFATPMX

SEQ ID NO: 34038 - protein, 11 aa, Artificial Sequence
  Description of Artificial Sequence: Synthetic peptide
  Seed: LAMPFATPMEA (CTG1B_HUMAN)
  misc_feature (2)..(2): Xaa can be Pro, Gly, Leu, His, Ala, Arg, Trp, Val, Ile, Thr, Glu, Phe, Asp, Tyr, Cys, Met, Asn, Lys, Ser, or Gln
  misc_feature (11)..(11): Xaa can be Ala, Val, Cys, Pro, Ser, Thr, or Ile
LXMPFATPMEX

SEQ ID NO: 34039 - protein, 8 aa, Artificial Sequence
  Description of Artificial Sequence: Synthetic peptide
  Seed: LAQDAPPL (CTG1B_HUMAN)
  misc_feature (2)..(2): Xaa can be Ala, Ser, Thr, Ile, Gln, Pro, Val, Gly, Phe, Arg, Tyr, or Met
  misc_feature (8)..(8): Xaa can be Leu, Ile, Tyr, Met, Lys, Arg, Val, Phe, or His
LXQDAPPX

SEQ ID NO: 34040 - protein, 10 aa, Artificial Sequence
  Description of Artificial Sequence: Synthetic peptide
  Seed: LAQDAPPLPV (CTG1B_HUMAN)
  misc_feature (2)..(2): Xaa can be Met, Ala, Leu, Pro, Ser, Val, Gln, Thr, Ile, Tyr, Gly, Cys, Phe, Trp, Glu, Arg, Asn, His, Asp, or Lys
  misc_feature (10)..(10): Xaa can be Leu, Met, Arg, Phe, Lys, Tyr, Val, Ile, His, Ala, Cys, Trp, Thr, or Gln
LXQDAPPLPX

SEQ ID NO: 34041 - protein, 9 aa, Artificial Sequence
  Description of Artificial Sequence: Synthetic peptide
  Seed: LAQPPSGQR (CTG1B_HUMAN)
  misc_feature (2)..(2): Xaa can be Ala, Gly, Thr, Ser, Val, Ile, Met, Gln, Leu, Phe, Tyr, Asn, Pro, Trp, Cys, Glu, Asp, Lys, His, or Arg
  misc_feature (9)..(9): Xaa can be Tyr, Phe, Lys, Arg, Met, Leu, Val, His, Ile, Trp, Ala, Thr, Cys, Pro, Ser, or Gln
LXQPPSGQX

SEQ ID NO: 34042 - protein, 10 aa, Artificial Sequence
  Description of Artificial Sequence: Synthetic peptide
  Seed: LAQPPSGQRR (CTG1B_HUMAN)
  misc_feature (2)..(2): Xaa can be Ala, Ser, Val, Thr, Ile, Leu, Met, Gly, Gln, Pro, Asn, Phe, Tyr, Trp, Asp, Cys, Glu, or Hi s
  misc_feature (10)..(10): Xaa can be Arg, Lys, Leu, Met, Tyr, Phe, Ile, Val, Trp, Ala, Cys, or His
LXQPPSGQRX

SEQ ID NO: 34043 - protein, 9 aa, Artificial Sequence
  Description of Artificial Sequence: Synthetic peptide
  Seed: LEFYLAMPF (CTG1B_HUMAN)
  misc_feature (2)..(2): Xaa can be Pro, Glu, Gln, Met, Lys, Ala, His, Leu, Arg, Val, Thr, Ser, Ile, Asp, Asn, Gly, Tyr, Phe, Cys, or Trp
  misc_feature (9)..(9): Xaa can be Tyr, Leu, Phe, Met, Ile, Trp, His, Val, Ala, Gly, Thr, Ser, Cys, Pro, Gln, Asn, Glu, Asp, Lys, or Arg
LXFYLAMPX

SEQ ID NO: 34044 - protein, 10 aa, Artificial Sequence
  Description of Artificial Sequence: Synthetic peptide
  Seed: LEFYLAMPFA (CTG1B_HUMAN)
  misc_feature (2)..(2): Xaa can be Met, Lys, Gln, Glu, His, Ala, Ser, Arg, Leu, Tyr, Val, Asn, Ile, Thr, Pro, Gly, Phe, or As p
  misc_feature (10)..(10): Xaa can be Tyr, Phe, Met, Leu, Trp, Ile, His, Ala, Val, Gln, Cys, Asn, Ser, Gly, Pro, Lys, Thr, Arg, Glu, or Asp
LXFYLAMPFX

SEQ ID NO: 34045 - protein, 10 aa, Artificial Sequence
  Description of Artificial Sequence: Synthetic peptide
  Seed: LKEFTVSGNI (CTG1B_HUMAN)
  misc_feature (2)..(2): Xaa can be Met, Arg, Ala, Val, Pro, Asp, Asn, Leu, Phe, Ile, Thr, Ser, Gln, Glu, Trp, Tyr, His, Gly, Cys, or Lys
  misc_feature (10)..(10): Xaa can be Ile, or Val
LXEFTVSGNX

SEQ ID NO: 34046 - protein, 10 aa, Artificial Sequence
  Description of Artificial Sequence: Synthetic peptide
  Seed: LLEFYLAMPF (CTG1B_HUMAN)
  misc_feature (2)..(2): Xaa can be Ala, Cys, Lys, Glu, Gly, Pro, Asn, His, Met, Thr, Asp, Gln, Ser, Ile, Val, Phe, Trp, Arg, Leu, or Tyr
  misc_feature (10)..(10): Xaa can be Tyr, Met, Thr, His, Trp, Val, Ile, Ala, Phe, or Leu
LXEFYLAMPX

SEQ ID NO: 34047 - protein, 11 aa, Artificial Sequence
  Description of Artificial Sequence: Synthetic peptide
  Seed: LLEFYLAMPFA (CTG1B_HUMAN)
  misc_feature (2)..(2): Xaa can be Met, Leu, or Ile
  misc_feature (11)..(11): Xaa can be Val, Ile, Ala, or Leu
LXEFYLAMPFX

SEQ ID NO: 34048 - protein, 9 aa, Artificial Sequence
  Description of Artificial Sequence: Synthetic peptide
  Seed: LLKEFTVSG (CTG1B_HUMAN)
  misc_feature (2)..(2): Xaa can be Met, Leu, Ile, Gln, Val, Thr, Ser, or Ala
  misc_feature (9)..(9): Xaa can be Val, Ile, Leu, Ala, Met, Thr, Phe, Pro, Ser, Cys, or Gly
LXKEFTVSX

SEQ ID NO: 34049 - protein, 11 aa, Artificial Sequence
  Description of Artificial Sequence: Synthetic peptide
  Seed: LLKEFTVSGNI (CTG1B_HUMAN)
  misc_feature (2)..(2): Xaa can be Leu, Met, or Ile
  misc_feature (11)..(11): Xaa can be Val, Ile, Leu, or Ala
LXKEFTVSGNX

SEQ ID NO: 34050 - protein, 9 aa, Artificial Sequence
  Description of Artificial Sequence: Synthetic peptide
  Seed: LLMWITQCF (CTG1B_HUMAN)
  misc_feature (2)..(2): Xaa can be Pro, Met, Leu, Gln, Lys, Ile, Ala, Tyr, Ser, Thr, Val, His, Phe, Trp, Arg, Gly, Asn, Glu, Cys, or Asp
  misc_feature (9)..(9): Xaa can be Tyr, Trp, Phe, Leu, Met, Val, Ile, Ala, His, Thr, Cys, Ser, Pro, Gly, Glu, Asn, or Gln
LXMWITQCX

SEQ ID NO: 34051 - protein, 10 aa, Artificial Sequence
  Description of Artificial Sequence: Synthetic peptide
  Seed: LLMWITQCFL (CTG1B_HUMAN)
  misc_feature (2)..(2): Xaa can be Met, Leu, Val, Gln, Ile, Thr, Phe, Ala, Trp, Asn, Ser, Gly, Tyr, Cys, Asp, Pro, Glu, Arg, His, or Lys
  misc_feature (10)..(10): Xaa can be Ile, Val, Ala, Leu, Met, Lys, Arg, Tyr, Thr, Phe, Gly, Ser, Cys, or Pro
LXMWITQCFX

SEQ ID NO: 34052 - protein, 11 aa, Artificial Sequence
  Description of Artificial Sequence: Synthetic peptide
  Seed: LLMWITQCFLP (CTG1B_HUMAN)
  misc_feature (2)..(2): Xaa can be Leu, Met, Phe, Tyr, Ile, Ser, Val, Gln, Arg, Lys, Thr, Gly, Trp, Ala, His, or Asn
  misc_feature (11)..(11): Xaa can be Val, Ile, Leu, Ala, Asp, Pro, Glu, Arg, Gln, Asn, Lys, Cys, Phe, His, Met, Gly, Ser, Trp, Tyr, or Thr
LXMWITQCFLX

SEQ ID NO: 34053 - protein, 8 aa, Artificial Sequence
  Description of Artificial Sequence: Synthetic peptide
  Seed: LMWITQCF (CTG1B_HUMAN)
  misc_feature (2)..(2): Xaa can be Gln, Met, Lys, Ser, His, Leu, or Ala
  misc_feature (8)..(8): Xaa can be Tyr, Phe, Met, or Leu
LXWITQCX

SEQ ID NO: 34054 - protein, 9 aa, Artificial Sequence
  Description of Artificial Sequence: Synthetic peptide
  Seed: LMWITQCFL (CTG1B_HUMAN)
  misc_feature (2)..(2): Xaa can be Leu, Met, Gln, Thr, Val, Ile, Ser, Ala, Lys, His, Asn, Gly, Glu, Tyr, Phe, Arg, or Trp
  misc_feature (9)..(9): Xaa can be Phe, Tyr, Arg, Met, Lys, Leu, Ile, Val, Ala, Cys, Thr, Ser, His, or Trp
LXWITQCFX

SEQ ID NO: 34055 - protein, 10 aa, Artificial Sequence
  Description of Artificial Sequence: Synthetic peptide
  Seed: LMWITQCFLP (CTG1B_HUMAN)
  misc_feature (2)..(2): Xaa can be Met, Leu, Ile, Val, Gln, Thr, Ala, or Ser
  misc_feature (10)..(10): Xaa can be Val, Ile, Leu, Ala, Lys, Asn, Trp, Met, Gly, Pro, Asp, Cys, Glu, Phe, His, Thr, Gln, Tyr, Ser, or Arg
LXWITQCFLX

SEQ ID NO: 34056 - protein, 11 aa, Artificial Sequence
  Description of Artificial Sequence: Synthetic peptide
  Seed: LMWITQCFLPV (CTG1B_HUMAN)
  misc_feature (2)..(2): Xaa can be Leu, Met, Gln, Ile, Thr, or Val
  misc_feature (11)..(11): Xaa can be Val, Ile, Leu, or Ala
LXWITQCFLPX

SEQ ID NO: 34057 - protein, 10 aa, Artificial Sequence
  Description of Artificial Sequence: Synthetic peptide
  Seed: LNGCCRCGAR (CTG1B_HUMAN)
  misc_feature (2)..(2): Xaa can be Phe, Ile, Val, Met, Trp, Tyr, Leu, Thr, Gln, Ser, Ala, Asn, or Gly
  misc_feature (10)..(10): Xaa can be Arg, or Lys
LXGCCRCGAX

SEQ ID NO: 34058 - protein, 9 aa, Artificial Sequence
  Description of Artificial Sequence: Synthetic peptide
  Seed: LPVFLAQPP (CTG1B_HUMAN)
  misc_feature (2)..(2): Xaa can be Pro, Ala, Val, Ser, Met, Gly, Phe, Ile, Cys, Leu, Gln, or Thr
  misc_feature (9)..(9): Xaa can be Tyr, Phe, Met, Leu, Ala, Trp, Ile, Val, His, Arg, Gly, Glu, Ser, Gln, Pro, Cys, Lys, Thr, or Asn
LXVFLAQPX

SEQ ID NO: 34059 - protein, 10 aa, Artificial Sequence
  Description of Artificial Sequence: Synthetic peptide
  Seed: LPVFLAQPPS (CTG1B_HUMAN)
  misc_feature (2)..(2): Xaa can be Pro, or Ala
  misc_feature (10)..(10): Xaa can be Ala, Met, Tyr, Val, Cys, Ile, Phe, Gly, Thr, Ser, Pro, or Leu
LXVFLAQPPX

SEQ ID NO: 34060 - protein, 11 aa, Artificial Sequence
  Description of Artificial Sequence: Synthetic peptide
  Seed: LPVFLAQPPSG (CTG1B_HUMAN)
  misc_feature (2)..(2): Xaa can be , or Pro
  misc_feature (11)..(11): Xaa can be Ile, Leu, Met, Ala, Thr, Ser, Cys, Val, Gly, Pro, or Phe
LXVFLAQPPSX

SEQ ID NO: 34061 - protein, 8 aa, Artificial Sequence
  Description of Artificial Sequence: Synthetic peptide
  Seed: LPVPGVLL (CTG1B_HUMAN)
  misc_feature (2)..(2): Xaa can be Pro, Ala, Gln, Thr, Ser, Val, Gly, Ile, Leu, Glu, Asn, Met, His, Asp, Arg, Phe, or Cys
  misc_feature (8)..(8): Xaa can be Leu, Tyr, Ile, Val, Lys, Met, Arg, Phe, Ala, Trp, His, Pro, Thr, Ser, Cys, or Gly
LXVPGVLX

SEQ ID NO: 34062 - protein, 9 aa, Artificial Sequence
  Description of Artificial Sequence: Synthetic peptide
  Seed: LPVPGVLLK (CTG1B_HUMAN)
  misc_feature (2)..(2): Xaa can be Pro, Ala, Ser, Val, Thr, Gly, Ile, Leu, Met, Cys, Phe, Gln, Tyr, Asn, Glu, Asp, Trp, Arg, Lys, or His
  misc_feature (9)..(9): Xaa can be Tyr, Leu, Met, Phe, Lys, Arg, Val, Ile, Trp, His, Ala, Cys, Thr, Gly, Gln, Ser, Pro, Glu, or Asn
LXVPGVLLX

SEQ ID NO: 34063 - protein, 11 aa, Artificial Sequence
  Description of Artificial Sequence: Synthetic peptide
  Seed: LPVPGVLLKEF (CTG1B_HUMAN)
  misc_feature (2)..(2): Xaa can be Pro, or Ala
  misc_feature (11)..(11): Xaa can be Tyr, Pro, Leu, Ser, Phe, Cys, Met, Val, Thr, Ile, Ala, or Trp
LXVPGVLLKEX

SEQ ID NO: 34064 - protein, 9 aa, Artificial Sequence
  Description of Artificial Sequence: Synthetic peptide
  Seed: LQLSISSCL (CTG1B_HUMAN)
  misc_feature (2)..(2): Xaa can be Met, Leu, Gln, Glu, Thr, Ile, Ala, Lys, Val, Arg, His, Ser, Asp, Pro, Phe, Tyr, Asn, Gly, Cys, or Trp
  misc_feature (9)..(9): Xaa can be Tyr, Phe, Met, Val, Leu, Ile, Trp, Ala, His, Thr, or Cys
LXLSISSCX

SEQ ID NO: 34065 - protein, 8 aa, Artificial Sequence
  Description of Artificial Sequence: Synthetic peptide
  Seed: LQQLSLLM (CTG1B_HUMAN)
  misc_feature (2)..(2): Xaa can be Gln, Met, Lys, His, or Leu
  misc_feature (8)..(8): Xaa can be Tyr, Phe, Met, Ile, Val, or Leu
LXQLSLLX

SEQ ID NO: 34066 - protein, 9 aa, Artificial Sequence
  Description of Artificial Sequence: Synthetic peptide
  Seed: LQQLSLLMW (CTG1B_HUMAN)
  misc_feature (2)..(2): Xaa can be Gln, Thr, Ser, Met, Ala, Lys, Leu, Glu, Arg, His, Gly, Val, Asn, Pro, Phe, Ile, Tyr, Cys, Asp, or Trp
  misc_feature (9)..(9): Xaa can be Trp, Phe, Tyr, Met, Leu, Ile, Val, Cys, His, or Ala
LXQLSLLMX

SEQ ID NO: 34067 - protein, 10 aa, Artificial Sequence
  Description of Artificial Sequence: Synthetic peptide
  Seed: LQQLSLLMWI (CTG1B_HUMAN)
  misc_feature (2)..(2): Xaa can be Met, Leu, Pro, Asp, Trp, Arg, Tyr, Phe, Glu, Asn, Val, Ser, Thr, Gly, Lys, Gln, His, Cys, Ile, or Ala
  misc_feature (10)..(10): Xaa can be Leu, Val, Ile, Ala, Met, or Thr
LXQLSLLMWX

SEQ ID NO: 34068 - protein, 10 aa, Artificial Sequence
  Description of Artificial Sequence: Synthetic peptide
  Seed: LSISSCLQQL (CTG1B_HUMAN)
  misc_feature (2)..(2): Xaa can be Leu, Arg, Met, Ala, Thr, Val, Ile, Gln, Ser, Gly, Glu, Cys, Pro, Asn, Phe, Tyr, Trp, Lys, Asp, or His
  misc_feature (10)..(10): Xaa can be Ile, Trp, Val, Leu, Phe, Tyr, Met, Ala, Cys, Thr, Lys, His, or Arg
LXISSCLQQX

SEQ ID NO: 34069 - protein, 11 aa, Artificial Sequence
  Description of Artificial Sequence: Synthetic peptide
  Seed: LSLLMWITQCF (CTG1B_HUMAN)
  misc_feature (2)..(2): Xaa can be Ser, Thr, Cys, Ala, Asn, Gly, Met, Ile, or Val
  misc_feature (11)..(11): Xaa can be Trp, Phe, or Tyr
LXLLMWITQCX

SEQ ID NO: 34070 - protein, 9 aa, Artificial Sequence
  Description of Artificial Sequence: Synthetic peptide
  Seed: LTAADHRQL (CTG1B_HUMAN)
  misc_feature (2)..(2): Xaa can be Ala, Val, Ile, Ser, Thr, Gln, Gly, Leu, Glu, Arg, Met, Asn, Tyr, Phe, Cys, Asp, His, Pro, Lys, or Trp
  misc_feature (9)..(9): Xaa can be Trp, Phe, Tyr, Leu, Met, Val, Ile, Lys, His, Arg, Cys, or Ala
LXAADHRQX

SEQ ID NO: 34071 - protein, 11 aa, Artificial Sequence
  Description of Artificial Sequence: Synthetic peptide
  Seed: LTAADHRQLQL (CTG1B_HUMAN)
  misc_feature (2)..(2): Xaa can be Thr, Ser, Ala, Cys, Met, Leu, Val, Gly, Asn, Gln, Ile, Lys, Pro, Trp, Asp, Glu, His, Tyr, or Phe
  misc_feature (11)..(11): Xaa can be Trp, Phe, Ile, Leu, Tyr, Met, Val, or Cys
LXAADHRQLQX

SEQ ID NO: 34072 - protein, 11 aa, Artificial Sequence
  Description of Artificial Sequence: Synthetic peptide
  Seed: LTIRLTAADHR (CTG1B_HUMAN)
  misc_feature (2)..(2): Xaa can be Thr, Phe, Tyr, Ile, Leu, Met, Val, Gln, Ala, Trp, or Ser
  misc_feature (11)..(11): Xaa can be Arg, or Lys
LXIRLTAADHX

SEQ ID NO: 34073 - protein, 9 aa, Artificial Sequence
  Description of Artificial Sequence: Synthetic peptide
  Seed: MEAELARRS (CTG1B_HUMAN)
  misc_feature (2)..(2): Xaa can be Glu, Asp, or Gln
  misc_feature (9)..(9): Xaa can be Val, Met, Ile, Leu, Phe, Cys, Ala, Pro, Trp, Asp, Thr, Tyr, Ser, or Gly
MXAELARRX

SEQ ID NO: 34074 - protein, 10 aa, Artificial Sequence
  Description of Artificial Sequence: Synthetic peptide
  Seed: MEAELARRSL (CTG1B_HUMAN)
  misc_feature (2)..(2): Xaa can be Glu, Pro, Asp, Gln, His, Ser, Met, Ala, Arg, Cys, Tyr, Leu, Thr, Phe, Trp, Asn, Lys, Ile, Gly, or Val
  misc_feature (10)..(10): Xaa can be Leu, Met, Tyr, Phe, Val, Ile, Trp, Ala, Pro, Thr, Gly, His, Cys, or Ser
MXAELARRSX

SEQ ID NO: 34075 - protein, 11 aa, Artificial Sequence
  Description of Artificial Sequence: Synthetic peptide
  Seed: MEAELARRSLA (CTG1B_HUMAN)
  misc_feature (2)..(2): Xaa can be , or Glu
  misc_feature (11)..(11): Xaa can be Cys, Phe, Ile, Val, Leu, Ala, Pro, Met, or Thr
MXAELARRSLX

SEQ ID NO: 34076 - protein, 8 aa, Artificial Sequence
  Description of Artificial Sequence: Synthetic peptide
  Seed: MPFATPME (CTG1B_HUMAN)
  misc_feature (2)..(2): Xaa can be Pro, Ala, Met, Leu, Ser, Thr, Val, or Ile
  misc_feature (8)..(8): Xaa can be Tyr, Phe, Met, Ala, Ile, Trp, Pro, Leu, Val, or Glu
MXFATPMX

SEQ ID NO: 34077 - protein, 9 aa, Artificial Sequence
  Description of Artificial Sequence: Synthetic peptide
  Seed: MPFATPMEA (CTG1B_HUMAN)
  misc_feature (2)..(2): Xaa can be Pro, Ala, Gln, His, Thr, Arg, Val, Ser, Ile, Glu, Met, Leu, Gly, Lys, Asp, Asn, Cys, Phe, Tyr, or Trp
  misc_feature (9)..(9): Xaa can be Leu, Phe, Tyr, Met, Val, Trp, Ile, Ala, Cys, His, Thr, Ser, Pro, Gly, Lys, Arg, Asn, Glu, Gln, or Asp
MXFATPMEX

SEQ ID NO: 34078 - protein, 10 aa, Artificial Sequence
  Description of Artificial Sequence: Synthetic peptide
  Seed: MPFATPMEAE (CTG1B_HUMAN)
  misc_feature (2)..(2): Xaa can be Pro, Ala, Met, Val, Ser, Ile, Thr, Gly, Leu, Phe, Cys, Tyr, Gln, Trp, Glu, His, Asn, or Ly s
  misc_feature (10)..(10): Xaa can be Tyr, Phe, Met, Ala, Leu, Trp, Ile, His, Cys, Val, Gln, Gly, Lys, Pro, Thr, Asn, Asp, Arg, Ser, or Glu
MXFATPMEAX

SEQ ID NO: 34079 - protein, 11 aa, Artificial Sequence
  Description of Artificial Sequence: Synthetic peptide
  Seed: MPFATPMEAEL (CTG1B_HUMAN)
  misc_feature (2)..(2): Xaa can be Pro, Ala, Ser, Val, Gly, Ile, Met, Thr, Asn, Glu, Cys, Leu, Phe, His, Asp, Arg, Gln, Lys, Trp, or Tyr
  misc_feature (11)..(11): Xaa can be Trp, Phe, Tyr, Met, Leu, Ala, Ile, Val, Thr, His, Glu, Gln, Asp, Pro, Asn, Ser, Gly, Arg, Lys, or Cys
MXFATPMEAEX

SEQ ID NO: 34080 - protein, 9 aa, Artificial Sequence
  Description of Artificial Sequence: Synthetic peptide
  Seed: MQAEGRGTG (CTG1B_HUMAN)
  misc_feature (2)..(2): Xaa can be Gln, Met, Lys, Leu, His, Glu, Ala, Arg, Val, Ile, Ser, Gly, Phe, Tyr, Thr, Asn, Pro, Cys, or Trp
  misc_feature (9)..(9): Xaa can be Tyr, Phe, Met, Leu, Trp, His, Ile, Val, Ala, Ser, Cys, Gly, Thr, or Gln
MXAEGRGTX

SEQ ID NO: 34081 - protein, 10 aa, Artificial Sequence
  Description of Artificial Sequence: Synthetic peptide
  Seed: MWITQCFLPV (CTG1B_HUMAN)
  misc_feature (2)..(2): Xaa can be Met, Leu, Gln, Tyr, Val, Ser, Trp, Phe, Ala, Thr, His, Ile, Lys, Asp, Glu, Gly, Pro, Cys, Asn, or Arg
  misc_feature (10)..(10): Xaa can be Ile, Ala, Leu, Val, Met, Phe, Thr, Trp, Ser, Cys, Pro, Gly, or Tyr
MXITQCFLPX

SEQ ID NO: 34082 - protein, 11 aa, Artificial Sequence
  Description of Artificial Sequence: Synthetic peptide
  Seed: MWITQCFLPVF (CTG1B_HUMAN)
  misc_feature (2)..(2): Xaa can be Tyr, Thr, Ser, Trp, Ala, Pro, Gln, His, Val, Lys, Phe, Ile, Cys, Leu, Asn, Met, Arg, Glu, Gly, or Asp
  misc_feature (11)..(11): Xaa can be Tyr, Trp, Phe, Met, Ile, Leu, or Val
MXITQCFLPVX

SEQ ID NO: 34083 - protein, 11 aa, Artificial Sequence
  Description of Artificial Sequence: Synthetic peptide
  Seed: NAGGPGEAGAT (CTG1B_HUMAN)
  misc_feature (2)..(2): Xaa can be Gly, Ser, Ala, Val, Ile, Thr, Arg, Met, Gln, Leu, Asn, Cys, Trp, Phe, Pro, Glu, Asp, Tyr, Lys, or His
  misc_feature (11)..(11): Xaa can be Lys, Tyr, His, Gln, Arg, Phe, Glu, Met, Leu, Asn, Gly, Asp, Trp, Ser, Ile, Pro, Val, Cys, Ala, or Thr
NXGGPGEAGAX

SEQ ID NO: 34084 - protein, 9 aa, Artificial Sequence
  Description of Artificial Sequence: Synthetic peptide
  Seed: NGCCRCGAR (CTG1B_HUMAN)
  misc_feature (2)..(2): Xaa can be Val, Thr, Ser, Met, Phe, Ile, Ala, Tyr, Leu, Pro, Gly, Trp, Asp, Gln, or Asn
  misc_feature (9)..(9): Xaa can be Arg, Lys, or Tyr
NXCCRCGAX

SEQ ID NO: 34085 - protein, 10 aa, Artificial Sequence
  Description of Artificial Sequence: Synthetic peptide
  Seed: NILTIRLTAA (CTG1B_HUMAN)
  misc_feature (2)..(2): Xaa can be Tyr, Met, Leu, Phe, Ile, Val, Thr, Ser, Arg, Trp, Gly, Cys, Asp, His, Glu, Gln, Pro, Ala, Lys, or Asn
  misc_feature (10)..(10): Xaa can be Val, Ile, Ala, or Leu
NXLTIRLTAX

SEQ ID NO: 34086 - protein, 8 aa, Artificial Sequence
  Description of Artificial Sequence: Synthetic peptide
  Seed: PESRLLEF (CTG1B_HUMAN)
  misc_feature (2)..(2): Xaa can be Glu, or Asp
  misc_feature (8)..(8): Xaa can be Leu, Val, Ile, Met, or Phe
PXSRLLEX

SEQ ID NO: 34087 - protein, 9 aa, Artificial Sequence
  Description of Artificial Sequence: Synthetic peptide
  Seed: PESRLLEFY (CTG1B_HUMAN)
  misc_feature (2)..(2): Xaa can be Glu, or Gln
  misc_feature (9)..(9): Xaa can be Trp, Phe, or Tyr
PXSRLLEFX

SEQ ID NO: 34088 - protein, 11 aa, Artificial Sequence
  Description of Artificial Sequence: Synthetic peptide
  Seed: PGGNAGGPGEA (CTG1B_HUMAN)
  misc_feature (2)..(2): Xaa can be Gly, Ala, Ile, Gln, Val, Met, Asn, Ser, Leu, Arg, Glu, Pro, Cys, Phe, Thr, Asp, Trp, Tyr, His, or Lys
  misc_feature (11)..(11): Xaa can be Lys, Phe, Arg, Tyr, Asn, Leu, Glu, Met, His, Gln, Gly, Ile, Trp, Cys, Ser, Ala, Val, Asp, or Pro
PXGNAGGPGEX

SEQ ID NO: 34089 - protein, 8 aa, Artificial Sequence
  Description of Artificial Sequence: Synthetic peptide
  Seed: PLPVPGVL (CTG1B_HUMAN)
  misc_feature (2)..(2): Xaa can be Ala, Phe, Ile, Met, Leu, Thr, Gly, Ser, or Val
  misc_feature (8)..(8): Xaa can be Leu, Ile, or Met
PXPVPGVX

SEQ ID NO: 34090 - protein, 9 aa, Artificial Sequence
  Description of Artificial Sequence: Synthetic peptide
  Seed: PLPVPGVLL (CTG1B_HUMAN)
  misc_feature (2)..(2): Xaa can be Ala, Tyr, Arg, Phe, Met, Gln, Thr, Val, Leu, Ser, Ile, Gly, Trp, His, Asn, Pro, Cys, or Gl u
  misc_feature (9)..(9): Xaa can be Leu, Met, Phe, Val, Ile, Tyr, Lys, Ala, or Arg
PXPVPGVLX

SEQ ID NO: 34091 - protein, 8 aa, Artificial Sequence
  Description of Artificial Sequence: Synthetic peptide
  Seed: PPLPVPGV (CTG1B_HUMAN)
  misc_feature (2)..(2): Xaa can be Pro, Ala, or Ser
  misc_feature (8)..(8): Xaa can be Ile, Ala, Leu, Val, or Met
PXLPVPGX

SEQ ID NO: 34092 - protein, 9 aa, Artificial Sequence
  Description of Artificial Sequence: Synthetic peptide
  Seed: PPLPVPGVL (CTG1B_HUMAN)
  misc_feature (2)..(2): Xaa can be Pro, Ala, Val, Ser, Gly, Ile, Met, Gln, Leu, or Thr
  misc_feature (9)..(9): Xaa can be Ala, Leu, Ile, Val, Tyr, Met, Phe, Thr, Pro, Cys, Gly, or Ser
PXLPVPGVX

SEQ ID NO: 34093 - protein, 10 aa, Artificial Sequence
  Description of Artificial Sequence: Synthetic peptide
  Seed: PPLPVPGVLL (CTG1B_HUMAN)
  misc_feature (2)..(2): Xaa can be Pro, or Ala
  misc_feature (10)..(10): Xaa can be Val, Ala, Leu, Ile, Met, Pro, Gly, Phe, Ser, Thr, Tyr, or Cys
PXLPVPGVLX

SEQ ID NO: 34094 - protein, 9 aa, Artificial Sequence
  Description of Artificial Sequence: Synthetic peptide
  Seed: PRGPHGGAA (CTG1B_HUMAN)
  misc_feature (2)..(2): Xaa can be His, Gln, or Arg
  misc_feature (9)..(9): Xaa can be Ala, or Val
PXGPHGGAX

SEQ ID NO: 34095 - protein, 8 aa, Artificial Sequence
  Description of Artificial Sequence: Synthetic peptide
  Seed: QDAPPLPV (CTG1B_HUMAN)
  misc_feature (2)..(2): Xaa can be Glu, or Asp
  misc_feature (8)..(8): Xaa can be Ala, Leu, Phe, Val, Met, Ile, Tyr, Thr, Ser, Cys, Gly, or Pro
QXAPPLPX

SEQ ID NO: 34096 - protein, 9 aa, Artificial Sequence
  Description of Artificial Sequence: Synthetic peptide
  Seed: QDAPPLPVP (CTG1B_HUMAN)
  misc_feature (2)..(2): Xaa can be Glu, Asp, Gln, Ala, or Ser
  misc_feature (9)..(9): Xaa can be Leu, Ala, Thr, Met, Phe, Ile, Gly, Ser, Pro, Cys, Val, Arg, Asp, Tyr, Asn, Glu, Gln, His, Lys, or Trp
QXAPPLPVX

SEQ ID NO: 34097 - protein, 11 aa, Artificial Sequence
  Description of Artificial Sequence: Synthetic peptide
  Seed: QDAPPLPVPGV (CTG1B_HUMAN)
  misc_feature (2)..(2): Xaa can be Glu, Asp, or Gln
  misc_feature (11)..(11): Xaa can be Leu, Ala, Cys, Ile, Met, Val, Asp, Phe, Trp, Glu, Pro, Thr, Ser, Lys, Gln, Gly, or Tyr
QXAPPLPVPGX

SEQ ID NO: 34098 - protein, 10 aa, Artificial Sequence
  Description of Artificial Sequence: Synthetic peptide
  Seed: QLQLSISSCL (CTG1B_HUMAN)
  misc_feature (2)..(2): Xaa can be Leu, Met, Val, Ile, or Gln
  misc_feature (10)..(10): Xaa can be Val, Leu, Ile, or Ala
QXQLSISSCX

SEQ ID NO: 34099 - protein, 11 aa, Artificial Sequence
  Description of Artificial Sequence: Synthetic peptide
  Seed: QLSISSCLQQL (CTG1B_HUMAN)
  misc_feature (2)..(2): Xaa can be Gln, Met, or Leu
  misc_feature (11)..(11): Xaa can be Leu, Trp, Phe, Val, Met, or Ile
QXSISSCLQQX

SEQ ID NO: 34100 - protein, 9 aa, Artificial Sequence
  Description of Artificial Sequence: Synthetic peptide
  Seed: QQLSLLMWI (CTG1B_HUMAN)
  misc_feature (2)..(2): Xaa can be Arg, Gln, Met, Leu, Ala, Val, Thr, Ile, Ser, Lys, Glu, His, Gly, Asn, or Phe
  misc_feature (9)..(9): Xaa can be Val, Leu, Ile, Met, Ala, Tyr, Phe, Thr, Ser, Cys, Trp, Gly, or Pro
QXLSLLMWX

SEQ ID NO: 34101 - protein, 10 aa, Artificial Sequence
  Description of Artificial Sequence: Synthetic peptide
  Seed: QQLSLLMWIT (CTG1B_HUMAN)
  misc_feature (2)..(2): Xaa can be Gln, Met, Thr, Val, Leu, Ile, Ser, or Ala
  misc_feature (10)..(10): Xaa can be Val, Ile, Ala, Leu, Met, or Thr
QXLSLLMWIX

SEQ ID NO: 34102 - protein, 9 aa, Artificial Sequence
  Description of Artificial Sequence: Synthetic peptide
  Seed: RASGPGGGA (CTG1B_HUMAN)
  misc_feature (2)..(2): Xaa can be Pro, Ala, Ser, Val, Thr, Ile, Gly, Met, Gln, Leu, Asn, Glu, Cys, Asp, or Phe
  misc_feature (9)..(9): Xaa can be Tyr, Lys, Arg, Phe, Met, Leu, His, Ile, Val, Trp, Ala, Thr, Gln, Cys, Ser, Gly, or Pro
RXSGPGGGX

SEQ ID NO: 34103 - protein, 10 aa, Artificial Sequence
  Description of Artificial Sequence: Synthetic peptide
  Seed: RASGPGGGAP (CTG1B_HUMAN)
  misc_feature (2)..(2): Xaa can be Pro, Ala, Ser, Val, Thr, Met, Ile, Leu, Gly, Gln, Glu, Asn, Cys, Asp, Phe, Tyr, Trp, Lys, His, or Arg
  misc_feature (10)..(10): Xaa can be Tyr, Phe, Met, Leu, His, Lys, Trp, Ala, Ile, Arg, Val, Cys, Gln, Thr, Ser, Glu, Asn, Pro, Gly, or Asp
RXSGPGGGAX

SEQ ID NO: 34104 - protein, 11 aa, Artificial Sequence
  Description of Artificial Sequence: Synthetic peptide
  Seed: RASGPGGGAPR (CTG1B_HUMAN)
  misc_feature (2)..(2): Xaa can be Gly, Pro, Gln, Ile, Thr, Val, Ala, Arg, Ser, Asn, Met, Cys, Leu, Glu, Asp, Tyr, Phe, His, Trp, or Lys
  misc_feature (11)..(11): Xaa can be Asn, Tyr, Phe, Lys, His, Glu, Met, Gln, Trp, Leu, Ile, Arg, Val, Ala, Cys, Gly, Asp, Thr, Ser, or Pro
RXSGPGGGAPX

SEQ ID NO: 34105 - protein, 8 aa, Artificial Sequence
  Description of Artificial Sequence: Synthetic peptide
  Seed: RGPESRLL (CTG1B_HUMAN)
  misc_feature (2)..(2): Xaa can be Ala, Ser, Thr, Arg, Gln, Ile, His, Val, Tyr, Phe, Gly, Glu, Lys, Leu, Met, Asn, Asp, Pro, or Cys
  misc_feature (8)..(8): Xaa can be Leu, Met, Phe, Tyr, Ile, Val, or Trp
RXPESRLX

SEQ ID NO: 34106 - protein, 10 aa, Artificial Sequence
  Description of Artificial Sequence: Synthetic peptide
  Seed: RGPESRLLEF (CTG1B_HUMAN)
  misc_feature (2)..(2): Xaa can be Arg, Gln, Val, Met, Leu, Ala, Ile, Gly, Lys, Thr, Glu, Ser, Asn, Asp, Tyr, His, Phe, Pro, Cys, or Trp
  misc_feature (10)..(10): Xaa can be Ala, Phe, Ile, Val, Tyr, Leu, Trp, Met, Lys, His, Cys, Arg, Gln, Asn, or Thr
RXPESRLLEX

SEQ ID NO: 34107 - protein, 10 aa, Artificial Sequence
  Description of Artificial Sequence: Synthetic peptide
  Seed: RGPHGGAASG (CTG1B_HUMAN)
  misc_feature (2)..(2): Xaa can be Arg, Tyr, Met, Ile, Asn, Phe, His, Gly, Leu, Asp, Val, Cys, Pro, Trp, Ser, Glu, Ala, Thr, Gln, or Lys
  misc_feature (10)..(10): Xaa can be Trp, Leu, Thr, Val, Gly, Phe, Ala, Tyr, Ser, Met, Cys, or Ile
RXPHGGAASX

SEQ ID NO: 34108 - protein, 11 aa, Artificial Sequence
  Description of Artificial Sequence: Synthetic peptide
  Seed: RGPHGGAASGL (CTG1B_HUMAN)
  misc_feature (2)..(2): Xaa can be Gly, Ala, Arg, Val, Ser, Thr, Ile, Leu, Asn, Met, Pro, Gln, Cys, Tyr, His, Lys, Phe, Trp, Glu, or Asp
  misc_feature (11)..(11): Xaa can be Leu, Phe, Lys, Met, Tyr, Arg, Ile, Trp, Asn, Val, Gln, Glu, His, Asp, Cys, or Gly
RXPHGGAASGX

SEQ ID NO: 34109 - protein, 10 aa, Artificial Sequence
  Description of Artificial Sequence: Synthetic peptide
  Seed: RGPRGAGAAR (CTG1B_HUMAN)
  misc_feature (2)..(2): Xaa can be Arg, Gly, Gln, Met, Ala, Val, Leu, Ile, Asn, Ser, Tyr, Thr, Phe, Trp, Pro, Lys, Glu, or As p
  misc_feature (10)..(10): Xaa can be Lys, Arg, Phe, Leu, Tyr, His, Met, Ala, Asn, Ile, Glu, Trp, Val, or Gln
RXPRGAGAAX

SEQ ID NO: 34110 - protein, 8 aa, Artificial Sequence
  Description of Artificial Sequence: Synthetic peptide
  Seed: RLLEFYLA (CTG1B_HUMAN)
  misc_feature (2)..(2): Xaa can be Leu, Met, Val, Ile, Gln, or Thr
  misc_feature (8)..(8): Xaa can be Val, Ile, Leu, Ala, Met, or Thr
RXLEFYLX

SEQ ID NO: 34111 - protein, 9 aa, Artificial Sequence
  Description of Artificial Sequence: Synthetic peptide
  Seed: RLLEFYLAM (CTG1B_HUMAN)
  misc_feature (2)..(2): Xaa can be Gln, Met, Arg, Leu, Thr, Val, Lys, Ser, Ala, Ile, Glu, Tyr, His, Gly, Phe, Trp, Asn, Asp, Cys, or Pro
  misc_feature (9)..(9): Xaa can be Phe, Trp, Lys, Arg, Tyr, Met, Val, Leu, Ile, His, Ala, Thr, Cys, Ser, Gly, Gln, Glu, Pro, Asn, or Asp
RXLEFYLAX

SEQ ID NO: 34112 - protein, 10 aa, Artificial Sequence
  Description of Artificial Sequence: Synthetic peptide
  Seed: RLLEFYLAMP (CTG1B_HUMAN)
  misc_feature (2)..(2): Xaa can be Leu, Met, Gln, Val, Ile, Thr, Ser, Ala, His, Phe, Cys, Arg, Trp, Asn, Asp, Gly, Tyr, Pro, Lys, or Glu
  misc_feature (10)..(10): Xaa can be Ala, Val, Ile, Leu, Met, Thr, Cys, Ser, Pro, Gly, Phe, Lys, Tyr, Asp, Trp, Asn, Arg, Glu, Gln, or His
RXLEFYLAMX

SEQ ID NO: 34113 - protein, 11 aa, Artificial Sequence
  Description of Artificial Sequence: Synthetic peptide
  Seed: RLLEFYLAMPF (CTG1B_HUMAN)
  misc_feature (2)..(2): Xaa can be Gln, Lys, Ser, Ala, Asp, Glu, Met, His, Phe, Gly, Tyr, Leu, Arg, Ile, Thr, Cys, Pro, Asn, Trp, or Val
  misc_feature (11)..(11): Xaa can be Phe, Tyr, Cys, Thr, Ser, Ile, Met, Trp, Ala, Leu, Pro, Val, His, Gly, Glu, Lys, Asp, Asn, Arg, or Gln
RXLEFYLAMPX

SEQ ID NO: 34114 - protein, 10 aa, Artificial Sequence
  Description of Artificial Sequence: Synthetic peptide
  Seed: RLTAADHRQL (CTG1B_HUMAN)
  misc_feature (2)..(2): Xaa can be Gln, Ile, Leu, Met, Ser, Lys, Gly, Ala, Phe, Pro, Val, Tyr, Asp, Glu, Thr, Trp, His, Asn, Arg, or Cys
  misc_feature (10)..(10): Xaa can be Trp, Tyr, Phe, Leu, Met, Ile, Val, or Ala
RXTAADHRQX

SEQ ID NO: 34115 - protein, 9 aa, Artificial Sequence
  Description of Artificial Sequence: Synthetic peptide
  Seed: RQLQLSISS (CTG1B_HUMAN)
  misc_feature (2)..(2): Xaa can be Gln, Met, Leu, Ala, Val, Lys, Glu, His, Ile, Ser, Arg, Thr, Asn, Gly, Phe, Cys, Tyr, Asp, Trp, or Pro
  misc_feature (9)..(9): Xaa can be Tyr, Met, Phe, Leu, Ile, Val, His, Trp, Ala, Cys, Thr, Gly, Ser, Pro, Gln, or Asn
RXLQLSISX

SEQ ID NO: 34116 - protein, 10 aa, Artificial Sequence
  Description of Artificial Sequence: Synthetic peptide
  Seed: RQLQLSISSC (CTG1B_HUMAN)
  misc_feature (2)..(2): Xaa can be Glu, Gln, Met, Leu, Ile, Val, Ser, Thr, Asp, Ala, or Asn
  misc_feature (10)..(10): Xaa can be Val, Leu, Ile, Phe, Trp, Met, Cys, Ala, Thr, Tyr, Asp, Ser, Gln, Pro, Gly, or Glu
RXLQLSISSX

SEQ ID NO: 34117 - protein, 11 aa, Artificial Sequence
  Description of Artificial Sequence: Synthetic peptide
  Seed: RQLQLSISSCL (CTG1B_HUMAN)
  misc_feature (2)..(2): Xaa can be Arg, Gln, Met, Leu, Val, Ile, Ser, Glu, Thr, Ala, Cys, His, Pro, Trp, Gly, Asp, Tyr, Phe, Asn, or Lys
  misc_feature (11)..(11): Xaa can be Leu, Tyr, Met, Phe, Trp, Ile, Val, His, Arg, Gly, Pro, Ala, Ser, Lys, Gln, Thr, or Cys
RXLQLSISSCX

SEQ ID NO: 34118 - protein, 9 aa, Artificial Sequence
  Description of Artificial Sequence: Synthetic peptide
  Seed: RRSLAQDAP (CTG1B_HUMAN)
  misc_feature (2)..(2): Xaa can be Arg, Gln, His, or Lys
  misc_feature (9)..(9): Xaa can be Leu, Met, Ile, Phe, Trp, Tyr, Arg, Val, Thr, Lys, Cys, Pro, or Ala
RXSLAQDAX

SEQ ID NO: 34119 - protein, 11 aa, Artificial Sequence
  Description of Artificial Sequence: Synthetic peptide
  Seed: RRSLAQDAPPL (CTG1B_HUMAN)
  misc_feature (2)..(2): Xaa can be Arg, Glu, Pro, Val, Phe, Thr, Gln, Tyr, Trp, Leu, Asp, Cys, Lys, Ser, Met, Ala, Gly, Asn, His, or Ile
  misc_feature (11)..(11): Xaa can be Ile, Leu, Val, Phe, Cys, Tyr, Lys, His, Trp, Ala, Met, or Arg
RXSLAQDAPPX

SEQ ID NO: 34120 - protein, 10 aa, Artificial Sequence
  Description of Artificial Sequence: Synthetic peptide
  Seed: RSLAQDAPPL (CTG1B_HUMAN)
  misc_feature (2)..(2): Xaa can be Ser, Ala, Thr, Met, Val, Ile, Trp, Leu, Phe, Tyr, Gly, Gln, Asn, Arg, His, Glu, Asp, Pro, Lys, or Cys
  misc_feature (10)..(10): Xaa can be Ala, Trp, Leu, Ile, Val, Lys, Met, Phe, or Tyr
RXLAQDAPPX

SEQ ID NO: 34121 - protein, 9 aa, Artificial Sequence
  Description of Artificial Sequence: Synthetic peptide
  Seed: SCLQQLSLL (CTG1B_HUMAN)
  misc_feature (2)..(2): Xaa can be Arg, Ser, Ala, Gln, Thr, Gly, Asn, Ile, Val, Leu, Met, Phe, Cys, Lys, Asp, Glu, Trp, or Pr o
  misc_feature (9)..(9): Xaa can be Leu, Lys, Phe, Met, Tyr, Ile, Val, Arg, Trp, His, Cys, Glu, Ala, Thr, Asn, or Gln
SXLQQLSLX

SEQ ID NO: 34122 - protein, 11 aa, Artificial Sequence
  Description of Artificial Sequence: Synthetic peptide
  Seed: SCLQQLSLLMW (CTG1B_HUMAN)
  misc_feature (2)..(2): Xaa can be Thr, Ser, Gly, Cys, Val, Ala, Gln, Asp, Phe, Asn, Met, Pro, Glu, Leu, or Ile
  misc_feature (11)..(11): Xaa can be Trp, Phe, Met, Leu, Tyr, or Ile
SXLQQLSLLMX

SEQ ID NO: 34123 - protein, 9 aa, Artificial Sequence
  Description of Artificial Sequence: Synthetic peptide
  Seed: SGNILTIRL (CTG1B_HUMAN)
  misc_feature (2)..(2): Xaa can be Arg, Ala, Gln, Ser, Gly, Thr, Met, Tyr, Asn, Leu, Ile, Val, Glu, Phe, His, Cys, Asp, Trp, Lys, or Pro
  misc_feature (9)..(9): Xaa can be Leu, Phe, Met, Ile, Tyr, Val, Lys, Trp, Arg, Gln, His, Thr, Ala, or Cys
SXNILTIRX

SEQ ID NO: 34124 - protein, 9 aa, Artificial Sequence
  Description of Artificial Sequence: Synthetic peptide
  Seed: SGPGGGAPR (CTG1B_HUMAN)
  misc_feature (2)..(2): Xaa can be Gly, Ser, Arg, Val, Ala, Thr, Ile, Leu, Gln, Met, Asn, Tyr, Pro, Trp, Phe, Glu, Cys, His, Lys, or Asp
  misc_feature (9)..(9): Xaa can be His, Leu, Lys, Arg, Tyr, Met, Phe, Ile, Val, Trp, Ala, Gln, Asn, Cys, Glu, Thr, Ser, Pro, Gly, or Asp
SXPGGGAPX

SEQ ID NO: 34125 - protein, 10 aa, Artificial Sequence
  Description of Artificial Sequence: Synthetic peptide
  Seed: SGPGGGAPRG (CTG1B_HUMAN)
  misc_feature (2)..(2): Xaa can be Gly, Arg, Pro, Ala, Gln, Asn, Ile, Ser, Leu, Val, Met, Lys, Glu, Asp, or His
  misc_feature (10)..(10): Xaa can be Lys, Phe, Arg, Leu, Tyr, Asn, Gln, His, Met, Glu, Ala, Ile, Pro, Ser, Val, Gly, or Trp
SXPGGGAPRX

SEQ ID NO: 34126 - protein, 11 aa, Artificial Sequence
  Description of Artificial Sequence: Synthetic peptide
  Seed: SGPGGGAPRGP (CTG1B_HUMAN)
  misc_feature (2)..(2): Xaa can be Arg, Asn, Ser, Ile, Gln, Val, Ala, Pro, Gly, Leu, Met, Asp, Cys, Thr, Glu, Phe, His, Lys, Trp, or Tyr
  misc_feature (11)..(11): Xaa can be Arg, Met, Tyr, Lys, Leu, Glu, Phe, Gln, Asn, His, Gly, Ile, Asp, Ser, Trp, Pro, Cys, Ala, Val, or Thr
SXPGGGAPRGX

SEQ ID NO: 34127 - protein, 9 aa, Artificial Sequence
  Description of Artificial Sequence: Synthetic peptide
  Seed: SISSCLQQL (CTG1B_HUMAN)
  misc_feature (2)..(2): Xaa can be Met, Leu, Ile, Thr, Gln, Val, Ser, Arg, Ala, Gly, Glu, Tyr, Pro, Phe, Asn, Cys, Trp, His, Lys, or Asp
  misc_feature (9)..(9): Xaa can be Leu, Trp, Tyr, Met, Phe, Ile, Arg, Lys, Val, His, Cys, Ala, Thr, or Ser
SXSSCLQQX

SEQ ID NO: 34128 - protein, 9 aa, Artificial Sequence
  Description of Artificial Sequence: Synthetic peptide
  Seed: SLAQDAPPL (CTG1B_HUMAN)
  misc_feature (2)..(2): Xaa can be Ala, Met, Leu, Val, Gln, Ile, Ser, Thr, Glu, Gly, Lys, Pro, Phe, Tyr, Arg, Cys, Asn, Asp, His, or Trp
  misc_feature (9)..(9): Xaa can be Tyr, Phe, Met, Leu, Arg, Lys, Val, His, Ile, Trp, Ala, Thr, Cys, or Gln
SXAQDAPPX

SEQ ID NO: 34129 - protein, 10 aa, Artificial Sequence
  Description of Artificial Sequence: Synthetic peptide
  Seed: SLAQDAPPLP (CTG1B_HUMAN)
  misc_feature (2)..(2): Xaa can be Leu, Met, Ile, Gln, or Val
  misc_feature (10)..(10): Xaa can be Val, Leu, Ile, Phe, Ala, Thr, Met, Cys, Pro, Gly, Asp, Ser, or Tyr
SXAQDAPPLX

SEQ ID NO: 34130 - protein, 11 aa, Artificial Sequence
  Description of Artificial Sequence: Synthetic peptide
  Seed: SLAQDAPPLPV (CTG1B_HUMAN)
  misc_feature (2)..(2): Xaa can be Leu, Val, Ile, Met, or Gln
  misc_feature (11)..(11): Xaa can be Val, Ile, Leu, Met, Ala, or Cys
SXAQDAPPLPX

SEQ ID NO: 34131 - protein, 9 aa, Artificial Sequence
  Description of Artificial Sequence: Synthetic peptide
  Seed: SLLMWITQC (CTG1B_HUMAN)
  misc_feature (2)..(2): Xaa can be Leu, Met, Ile, Gln, Val, Ser, Ala, Thr, Phe, Asn, Trp, Glu, Cys, Gly, Asp, or Tyr
  misc_feature (9)..(9): Xaa can be Val, Leu, Ile, Ala, Met, Thr, Cys, Phe, Lys, Pro, Gly, or Ser
SXLMWITQX

SEQ ID NO: 34132 - protein, 10 aa, Artificial Sequence
  Description of Artificial Sequence: Synthetic peptide
  Seed: SLLMWITQCF (CTG1B_HUMAN)
  misc_feature (2)..(2): Xaa can be Gln, Met, Lys, Trp, Gly, Ile, Phe, Arg, Asn, Ala, His, Asp, Tyr, Glu, Thr, Leu, Ser, Val, Pro, or Cys
  misc_feature (10)..(10): Xaa can be Phe, Tyr, Trp, Met, Leu, Ile, or His
SXLMWITQCX

SEQ ID NO: 34133 - protein, 11 aa, Artificial Sequence
  Description of Artificial Sequence: Synthetic peptide
  Seed: SLLMWITQCFL (CTG1B_HUMAN)
  misc_feature (2)..(2): Xaa can be Phe, Leu, Tyr, Met, Ser, Lys, Arg, Glu, Gly, Val, Asn, Pro, Trp, Ile, Gln, Thr, Cys, Ala, His, or Asp
  misc_feature (11)..(11): Xaa can be Leu, Val, Ala, Ile, Met, or Thr
SXLMWITQCFX

SEQ ID NO: 34134 - protein, 8 aa, Artificial Sequence
  Description of Artificial Sequence: Synthetic peptide
  Seed: SRLLEFYL (CTG1B_HUMAN)
  misc_feature (2)..(2): Xaa can be Arg, or His
  misc_feature (8)..(8): Xaa can be Leu, Tyr, Val, Ile, Phe, or Met
SXLLEFYX

SEQ ID NO: 34135 - protein, 9 aa, Artificial Sequence
  Description of Artificial Sequence: Synthetic peptide
  Seed: SRLLEFYLA (CTG1B_HUMAN)
  misc_feature (2)..(2): Xaa can be Arg, His, Gln, or Lys
  misc_feature (9)..(9): Xaa can be Ile, Leu, Met, Val, Ala, Phe, Lys, Ser, Cys, Pro, Gly, Thr, Gln, Trp, His, Arg, or Tyr
SXLLEFYLX

SEQ ID NO: 34136 - protein, 10 aa, Artificial Sequence
  Description of Artificial Sequence: Synthetic peptide
  Seed: SRLLEFYLAM (CTG1B_HUMAN)
  misc_feature (2)..(2): Xaa can be Arg, Met, Gln, Phe, Glu, Trp, Tyr, Ala, Ser, Lys, Val, Pro, Thr, Gly, His, Leu, Cys, Asp, Asn, or Ile
  misc_feature (10)..(10): Xaa can be Ser, Tyr, Leu, Thr, Phe, Ile, Cys, Val, Ala, Met, Trp, His, Gly, Lys, Arg, or Pro
SXLLEFYLAX

SEQ ID NO: 34137 - protein, 9 aa, Artificial Sequence
  Description of Artificial Sequence: Synthetic peptide
  Seed: SSCLQQLSL (CTG1B_HUMAN)
  misc_feature (2)..(2): Xaa can be Arg, Glu, Gln, Ala, Asp, Ser, Thr, Ile, Val, Met, Gly, Asn, Lys, Leu, His, Phe, Tyr, Cys, Pro, or Trp
  misc_feature (9)..(9): Xaa can be Trp, Ile, Phe, Met, Tyr, Leu, Val, Lys, Arg, His, Cys, Ala, Thr, Pro, Gln, or Asn
SXCLQQLSX

SEQ ID NO: 34138 - protein, 10 aa, Artificial Sequence
  Description of Artificial Sequence: Synthetic peptide
  Seed: SSCLQQLSLL (CTG1B_HUMAN)
  misc_feature (2)..(2): Xaa can be Thr, Ser, Ala, Val, Cys, Met, Ile, Gly, Asn, Phe, Glu, Leu, Asp, Gln, or Pro
  misc_feature (10)..(10): Xaa can be Trp, Phe, Tyr, Leu, Met, or Ile
SXCLQQLSLX

SEQ ID NO: 34139 - protein, 11 aa, Artificial Sequence
  Description of Artificial Sequence: Synthetic peptide
  Seed: SSCLQQLSLLM (CTG1B_HUMAN)
  misc_feature (2)..(2): Xaa can be Ser, Thr, Ala, Met, Gly, Cys, Val, Ile, Asp, Phe, Gln, Pro, Leu, or Asn
  misc_feature (11)..(11): Xaa can be Trp, Phe, Leu, Tyr, Ile, or Met
SXCLQQLSLLX

SEQ ID NO: 34140 - protein, 11 aa, Artificial Sequence
  Description of Artificial Sequence: Synthetic peptide
  Seed: STGDADGPGGP (CTG1B_HUMAN)
  misc_feature (2)..(2): Xaa can be Ala, Leu, Trp, Asn, Thr, Arg, Pro, Ser, Val, Ile, Gly, Met, Cys, Phe, Gln, Tyr, Asp, His, Glu, or Lys
  misc_feature (11)..(11): Xaa can be Gln, Gly, His, Leu, Phe, Ile, Met, Lys, Trp, Arg, Glu, Asn, Asp, Tyr, Pro, Ser, Ala, Val, Cys, or Thr
SXGDADGPGGX

SEQ ID NO: 34141 - protein, 8 aa, Artificial Sequence
  Description of Artificial Sequence: Synthetic peptide
  Seed: TAADHRQL (CTG1B_HUMAN)
  misc_feature (2)..(2): Xaa can be Ala, Thr, Ser, Val, Ile, Tyr, His, Gln, Met, Gly, Glu, Leu, Arg, Phe, Trp, Pro, Cys, Asp, or Asn
  misc_feature (8)..(8): Xaa can be Leu, Met, Phe, Tyr, Ile, Val, Lys, Arg, Trp, or His
TXADHRQX

SEQ ID NO: 34142 - protein, 9 aa, Artificial Sequence
  Description of Artificial Sequence: Synthetic peptide
  Seed: TAADHRQLQ (CTG1B_HUMAN)
  misc_feature (2)..(2): Xaa can be Ala, Ile, Val, Ser, Gln, Thr, Met, Leu, Glu, Gly, Asn, Cys, Asp, Phe, Tyr, Pro, Lys, Trp, or Arg
  misc_feature (9)..(9): Xaa can be Tyr, Phe, Met, Leu, His, Lys, Trp, Val, Ile, Ala, Arg, Gln, Cys, or Thr
TXADHRQLX

SEQ ID NO: 34143 - protein, 10 aa, Artificial Sequence
  Description of Artificial Sequence: Synthetic peptide
  Seed: TAADHRQLQL (CTG1B_HUMAN)
  misc_feature (2)..(2): Xaa can be Ile, Gln, Ser, Val, Met, Ala, Pro, Arg, Leu, Thr, Gly, Glu, Phe, Tyr, Asn, Lys, Cys, His, Trp, or Asp
  misc_feature (10)..(10): Xaa can be Trp, Leu, Tyr, Phe, Met, Lys, Ile, Val, Arg, His, Cys, Ala, or Thr
TXADHRQLQX

SEQ ID NO: 34144 - protein, 11 aa, Artificial Sequence
  Description of Artificial Sequence: Synthetic peptide
  Seed: TGDADGPGGPG (CTG1B_HUMAN)
  misc_feature (2)..(2): Xaa can be Gly, Ala, Arg, Phe, Ile, Val, Trp, Pro, Ser, Met, Thr, Leu, Gln, Asn, Cys, Tyr, His, Lys, Asp, or Glu
  misc_feature (11)..(11): Xaa can be His, Phe, Tyr, Asn, Arg, Glu, Gln, Lys, Met, Leu, Gly, Asp, Trp, Pro, Ile, Ser, Cys, Ala, Thr, or Val
TXDADGPGGPX

SEQ ID NO: 34145 - protein, 10 aa, Artificial Sequence
  Description of Artificial Sequence: Synthetic peptide
  Seed: TGGRGPRGAG (CTG1B_HUMAN)
  misc_feature (2)..(2): Xaa can be Gly, Arg, Ala, Ser, Gln, Val, Pro, Ile, Asn, or Leu
  misc_feature (10)..(10): Xaa can be Lys, Phe, Leu, Arg, Tyr, Met, Glu, Gln, Asn, His, or Gly
TXGRGPRGAX

SEQ ID NO: 34146 - protein, 11 aa, Artificial Sequence
  Description of Artificial Sequence: Synthetic peptide
  Seed: TGGRGPRGAGA (CTG1B_HUMAN)
  misc_feature (2)..(2): Xaa can be Gly, Ala, Arg, Ile, Ser, Val, Gln, Pro, Met, Leu, Thr, Asn, Cys, Asp, Glu, Phe, Trp, His, Lys, or Tyr
  misc_feature (11)..(11): Xaa can be Lys, Phe, Asn, Arg, Glu, Gln, Tyr, Leu, His, Met, Gly, Ile, Ser, Asp, Trp, Cys, Pro, Thr, Val, or Ala
TXGRGPRGAGX

SEQ ID NO: 34147 - protein, 11 aa, Artificial Sequence
  Description of Artificial Sequence: Synthetic peptide
  Seed: TGGSTGDADGP (CTG1B_HUMAN)
  misc_feature (2)..(2): Xaa can be Gly, Ala, Ile, Val, Ser, Asn, Leu, Arg, Gln, Met, Thr, Pro, Cys, Glu, Asp, Phe, Trp, His, Lys, or Tyr
  misc_feature (11)..(11): Xaa can be Lys, Arg, Phe, Glu, Tyr, Asn, Gln, His, Leu, Met, Gly, Ile, Pro, Trp, Cys, Val, Ser, Ala, or Asp
TXGSTGDADGX

SEQ ID NO: 34148 - protein, 10 aa, Artificial Sequence
  Description of Artificial Sequence: Synthetic peptide
  Seed: TIRLTAADHR (CTG1B_HUMAN)
  misc_feature (2)..(2): Xaa can be Ile, Tyr, Thr, Val, Phe, Leu, Met, Ser, Gln, Ala, or Trp
  misc_feature (10)..(10): Xaa can be Arg, or Lys
TXRLTAADHX

SEQ ID NO: 34149 - protein, 8 aa, Artificial Sequence
  Description of Artificial Sequence: Synthetic peptide
  Seed: TPMEAELA (CTG1B_HUMAN)
  misc_feature (2)..(2): Xaa can be , or Pro
  misc_feature (8)..(8): Xaa can be Ile, Met, Ala, Leu, or Val
TXMEAELX

SEQ ID NO: 34150 - protein, 9 aa, Artificial Sequence
  Description of Artificial Sequence: Synthetic peptide
  Seed: TPMEAELAR (CTG1B_HUMAN)
  misc_feature (2)..(2): Xaa can be Pro, Ala, Val, Met, Ile, Ser, Thr, Leu, Gly, Gln, Cys, Asp, Phe, Glu, Asn, Tyr, Trp, His, Arg, or Lys
  misc_feature (9)..(9): Xaa can be Arg, Lys, Tyr, Phe, Ala, Met, Leu, His, Val, Trp, Ile, Cys, Thr, Pro, Gly, Asn, Gln, Ser, or Glu
TXMEAELAX

SEQ ID NO: 34151 - protein, 10 aa, Artificial Sequence
  Description of Artificial Sequence: Synthetic peptide
  Seed: TPMEAELARR (CTG1B_HUMAN)
  misc_feature (2)..(2): Xaa can be Thr, Val, Ala, Ile, Ser, Met, Trp, Gly, Asp, Phe, Leu, Glu, Gln, Asn, Tyr, Pro, His, Cys, or Lys
  misc_feature (10)..(10): Xaa can be Arg, Lys, Tyr, Met, Phe, Leu, His, Val, Gln, Ile, Glu, Ala, Asp, Gly, Cys, Thr, Ser, Asn, Pro, or Trp
TXMEAELARX

SEQ ID NO: 34152 - protein, 8 aa, Artificial Sequence
  Description of Artificial Sequence: Synthetic peptide
  Seed: TQCFLPVF (CTG1B_HUMAN)
  misc_feature (2)..(2): Xaa can be Gln, Met, Glu, Ala, Ser, Asn, Gly, Leu, Val, Pro, Arg, Ile, or Thr
  misc_feature (8)..(8): Xaa can be Ile, Val, Leu, Tyr, Phe, or Met
TXCFLPVX

SEQ ID NO: 34153 - protein, 9 aa, Artificial Sequence
  Description of Artificial Sequence: Synthetic peptide
  Seed: TQCFLPVFL (CTG1B_HUMAN)
  misc_feature (2)..(2): Xaa can be His, Glu, Met, Leu, Gln, Arg, Ile, Thr, Val, Ala, Ser, Asp, Gly, Tyr, Asn, Lys, Phe, Trp, or Cys
  misc_feature (9)..(9): Xaa can be Leu, Met, Tyr, Phe, Val, Ile, Ala, Cys, Trp, Thr, Pro, or Ser
TXCFLPVFX

SEQ ID NO: 34154 - protein, 10 aa, Artificial Sequence
  Description of Artificial Sequence: Synthetic peptide
  Seed: TQCFLPVFLA (CTG1B_HUMAN)
  misc_feature (2)..(2): Xaa can be Gln, Met, Val, Leu, Ser, Ala, Ile, or Thr
  misc_feature (10)..(10): Xaa can be Val, Leu, Ala, Ile, or Met
TXCFLPVFLX

SEQ ID NO: 34155 - protein, 9 aa, Artificial Sequence
  Description of Artificial Sequence: Synthetic peptide
  Seed: TVSGNILTI (CTG1B_HUMAN)
  misc_feature (2)..(2): Xaa can be Ala, Pro, Arg, Met, Val, Leu, Ser, Thr, Gln, Ile, Gly, Phe, Tyr, Glu, Cys, Asn, His, Asp, Trp, or Lys
  misc_feature (9)..(9): Xaa can be Val, Trp, Met, Phe, Ile, Tyr, Leu, Lys, Arg, His, Ala, Cys, Thr, Gln, Ser, Gly, Asn, or Pr o
TXSGNILTX

SEQ ID NO: 34156 - protein, 10 aa, Artificial Sequence
  Description of Artificial Sequence: Synthetic peptide
  Seed: TVSGNILTIR (CTG1B_HUMAN)
  misc_feature (2)..(2): Xaa can be Ala, Ser, Thr, Ile, Met, Val, Gln, Glu, Gly, Leu, Asn, Cys, Phe, Asp, Pro, Lys, Arg, Trp, Tyr, or His
  misc_feature (10)..(10): Xaa can be Arg, Lys, Tyr, Phe, Met, Leu, His, Trp, Ile, or Val
TXSGNILTIX

SEQ ID NO: 34157 - protein, 11 aa, Artificial Sequence
  Description of Artificial Sequence: Synthetic peptide
  Seed: VFLAQPPSGQR (CTG1B_HUMAN)
  misc_feature (2)..(2): Xaa can be Phe, Trp, Ser, Ala, Ile, Thr, Leu, Gly, Val, Met, Tyr, or Arg
  misc_feature (11)..(11): Xaa can be , or Arg
VXLAQPPSGQX

SEQ ID NO: 34158 - protein, 8 aa, Artificial Sequence
  Description of Artificial Sequence: Synthetic peptide
  Seed: VLLKEFTV (CTG1B_HUMAN)
  misc_feature (2)..(2): Xaa can be Leu, or Met
  misc_feature (8)..(8): Xaa can be , or Val
VXLKEFTX

SEQ ID NO: 34159 - protein, 9 aa, Artificial Sequence
  Description of Artificial Sequence: Synthetic peptide
  Seed: VPGVLLKEF (CTG1B_HUMAN)
  misc_feature (2)..(2): Xaa can be Pro, Ala, Met, Ser, Gln, Thr, Glu, Ile, Val, Leu, Gly, Asp, Asn, or Phe
  misc_feature (9)..(9): Xaa can be Tyr, Phe, Met, Trp, Ala, Cys, Pro, Leu, Val, Ser, Thr, Ile, or Gly
VXGVLLKEX

SEQ ID NO: 34160 - protein, 8 aa, Artificial Sequence
  Description of Artificial Sequence: Synthetic peptide
  Seed: VSGNILTI (CTG1B_HUMAN)
  misc_feature (2)..(2): Xaa can be Ala, Thr, Ser, Val, Gln, Gly, Leu, Ile, Asn, Met, Phe, Asp, Arg, Pro, Glu, His, Cys, Tyr, or Trp
  misc_feature (8)..(8): Xaa can be Leu, Ile, Val, Trp, Met, Tyr, Phe, Lys, Arg, His, or Ala
VXGNILTX

SEQ ID NO: 34161 - protein, 9 aa, Artificial Sequence
  Description of Artificial Sequence: Synthetic peptide
  Seed: VSGNILTIR (CTG1B_HUMAN)
  misc_feature (2)..(2): Xaa can be Ala, Thr, Val, Ser, Leu, Gly, Met, Ile, Cys, Gln, Phe, Tyr, Asn, Asp, Trp, His, Pro, or Gl u
  misc_feature (9)..(9): Xaa can be Arg, Lys, Tyr, Leu, Met, Phe, Ile, Val, Trp, His, or Ala
VXGNILTIX

SEQ ID NO: 34162 - protein, 10 aa, Artificial Sequence
  Description of Artificial Sequence: Synthetic peptide
  Seed: VSGNILTIRL (CTG1B_HUMAN)
  misc_feature (2)..(2): Xaa can be Thr, Ser, Ala, Ile, Cys, Val, Met, Gly, Leu, Glu, Gln, Phe, Pro, Asp, or Asn
  misc_feature (10)..(10): Xaa can be Trp, Phe, Leu, Tyr, Met, or Ile
VXGNILTIRX

SEQ ID NO: 34163 - protein, 9 aa, Artificial Sequence
  Description of Artificial Sequence: Synthetic peptide
  Seed: WITQCFLPV (CTG1B_HUMAN)
  misc_feature (2)..(2): Xaa can be Gln, Met, Leu, Thr, Ile, Val, Ala, or Ser
  misc_feature (9)..(9): Xaa can be Ile, Leu, Ala, Val, Met, Thr, or Phe
WXTQCFLPX

SEQ ID NO: 34164 - protein, 10 aa, Artificial Sequence
  Description of Artificial Sequence: Synthetic peptide
  Seed: WITQCFLPVF (CTG1B_HUMAN)
  misc_feature (2)..(2): Xaa can be Gln, Met, Lys, Ser, Arg, Thr, His, Glu, Ala, Leu, Ile, Tyr, Phe, Val, Cys, Asp, Trp, Gly, Pro, or Asn
  misc_feature (10)..(10): Xaa can be Tyr, Trp, Phe, Met, Leu, Ile, Val, or His
WXTQCFLPVX

SEQ ID NO: 34165 - protein, 8 aa, Artificial Sequence
  Description of Artificial Sequence: Synthetic peptide
  Seed: YLAMPFAT (CTG1B_HUMAN)
  misc_feature (2)..(2): Xaa can be Met, Leu, Ile, Val, Gln, or Thr
  misc_feature (8)..(8): Xaa can be Val, Ile, Leu, Met, Ala, or Thr
YXAMPFAX

SEQ ID NO: 34166 - protein, 9 aa, Artificial Sequence
  Description of Artificial Sequence: Synthetic peptide
  Seed: YLAMPFATP (CTG1B_HUMAN)
  misc_feature (2)..(2): Xaa can be Met, Leu, Gln, Ile, Val, Thr, Ser, Ala, Gly, Asn, Phe, Cys, Trp, Glu, Lys, Tyr, or Asp
  misc_feature (9)..(9): Xaa can be Val, Leu, Ile, Ala, Met, Thr, Ser, Phe, Cys, Gly, Pro, Glu, Asp, or Trp
YXAMPFATX

SEQ ID NO: 34167 - protein, 10 aa, Artificial Sequence
  Description of Artificial Sequence: Synthetic peptide
  Seed: YLAMPFATPM (CTG1B_HUMAN)
  misc_feature (2)..(2): Xaa can be Pro, Met, Gln, Thr, Leu, Val, Tyr, Ile, Ala, Ser, Lys, Asn, Gly, Phe, Trp, His, Asp, Glu, Arg, or Cys
  misc_feature (10)..(10): Xaa can be Ala, Leu, Tyr, Val, Arg, Thr, Trp, His, Phe, Ile, Met, Lys, Ser, Cys, Gly, Gln, Pro, Glu, Asp, or Asn
YXAMPFATPX

SEQ ID NO: 34168 - protein, 11 aa, Artificial Sequence
  Description of Artificial Sequence: Synthetic peptide
  Seed: YLAMPFATPME (CTG1B_HUMAN)
  misc_feature (2)..(2): Xaa can be Thr, Gly, Gln, Asp, Leu, Pro, Trp, Cys, Glu, Met, Ser, Tyr, Ala, Arg, Lys, Phe, Asn, His, Ile, or Val
  misc_feature (11)..(11): Xaa can be Gln, Trp, Thr, Leu, Gly, Ser, His, Ile, Tyr, Arg, Ala, Asn, Glu, Asp, Lys, Cys, Val, Pro, Phe, or Met
YXAMPFATPMX

SEQ ID NO: 34169 - protein, 9 aa, Artificial Sequence
  Description of Artificial Sequence: Synthetic peptide
  Seed: AAAFVNQHL (INS_HUMAN)
AAAFVNQHM

SEQ ID NO: 34170 - protein, 9 aa, Artificial Sequence
  Description of Artificial Sequence: Synthetic peptide
  Seed: ALWMRLLPL (INS_HUMAN)
AMWMRLLPI

SEQ ID NO: 34171 - protein, 9 aa, Artificial Sequence
  Description of Artificial Sequence: Synthetic peptide
  Seed: AGSLQPLAL (INS_HUMAN)
ARSLQPLAL

SEQ ID NO: 34172 - protein, 11 aa, Artificial Sequence
  Description of Artificial Sequence: Synthetic peptide
  Seed: ALWGPDPAAAF (INS_HUMAN)
ARWGPDPAAAY

SEQ ID NO: 34173 - protein, 9 aa, Artificial Sequence
  Description of Artificial Sequence: Synthetic peptide
  Seed: ALYLVCGER (INS_HUMAN)
ATYLVCGER

SEQ ID NO: 34174 - protein, 9 aa, Artificial Sequence
  Description of Artificial Sequence: Synthetic peptide
  Seed: FFYTPKTRR (INS_HUMAN)
FSYTPKTRR

SEQ ID NO: 34175 - protein, 9 aa, Artificial Sequence
  Description of Artificial Sequence: Synthetic peptide
  Seed: FFYTPKTRR (INS_HUMAN)
FTYTPKTRR

SEQ ID NO: 34176 - protein, 9 aa, Artificial Sequence
  Description of Artificial Sequence: Synthetic peptide
  Seed: GERGFFYTP (INS_HUMAN)
GERGFFYTA

SEQ ID NO: 34177 - protein, 9 aa, Artificial Sequence
  Description of Artificial Sequence: Synthetic peptide
  Seed: GPDPAAAFV (INS_HUMAN)
GFDPAAAFL

SEQ ID NO: 34178 - protein, 9 aa, Artificial Sequence
  Description of Artificial Sequence: Synthetic peptide
  Seed: GSHLVEALY (INS_HUMAN)
GMHLVEALY

SEQ ID NO: 34179 - protein, 9 aa, Artificial Sequence
  Description of Artificial Sequence: Synthetic peptide
  Seed: GSHLVEALY (INS_HUMAN)
GTHLVEALY

SEQ ID NO: 34180 - protein, 9 aa, Artificial Sequence
  Description of Artificial Sequence: Synthetic peptide
  Seed: HLVEALYLV (INS_HUMAN)
HQVEALYLV

SEQ ID NO: 34181 - protein, 9 aa, Artificial Sequence
  Description of Artificial Sequence: Synthetic peptide
  Seed: HLVEALYLV (INS_HUMAN)
HTVEALYLA

SEQ ID NO: 34182 - protein, 9 aa, Artificial Sequence
  Description of Artificial Sequence: Synthetic peptide
  Seed: HLVEALYLV (INS_HUMAN)
HVVEALYLI

SEQ ID NO: 34183 - protein, 10 aa, Artificial Sequence
  Description of Artificial Sequence: Synthetic peptide
  Seed: LPLLALLALW (INS_HUMAN)
LALLALLALW

SEQ ID NO: 34184 - protein, 9 aa, Artificial Sequence
  Description of Artificial Sequence: Synthetic peptide
  Seed: LPLLALLAL (INS_HUMAN)
LPLLALLAF

SEQ ID NO: 34185 - protein, 9 aa, Artificial Sequence
  Description of Artificial Sequence: Synthetic peptide
  Seed: LPLLALLAL (INS_HUMAN)
LPLLALLAM

SEQ ID NO: 34186 - protein, 9 aa, Artificial Sequence
  Description of Artificial Sequence: Synthetic peptide
  Seed: LALEGSLQK (INS_HUMAN)
LTLEGSLQK

SEQ ID NO: 34187 - protein, 9 aa, Artificial Sequence
  Description of Artificial Sequence: Synthetic peptide
  Seed: LWMRLLPLL (INS_HUMAN)
LWMRLLPLW

SEQ ID NO: 34188 - protein, 9 aa, Artificial Sequence
  Description of Artificial Sequence: Synthetic peptide
  Seed: LWMRLLPLL (INS_HUMAN)
LYMRLLPLF

SEQ ID NO: 34189 - protein, 9 aa, Artificial Sequence
  Description of Artificial Sequence: Synthetic peptide
  Seed: LWMRLLPLL (INS_HUMAN)
LYMRLLPLI

SEQ ID NO: 34190 - protein, 10 aa, Artificial Sequence
  Description of Artificial Sequence: Synthetic peptide
  Seed: MALWMRLLPL (INS_HUMAN)
MPLWMRLLPF

SEQ ID NO: 34191 - protein, 10 aa, Artificial Sequence
  Description of Artificial Sequence: Synthetic peptide
  Seed: MALWMRLLPL (INS_HUMAN)
MPLWMRLLPV

SEQ ID NO: 34192 - protein, 9 aa, Artificial Sequence
  Description of Artificial Sequence: Synthetic peptide
  Seed: QHLCGSHLV (INS_HUMAN)
QHLCGSHLL

SEQ ID NO: 34193 - protein, 10 aa, Artificial Sequence
  Description of Artificial Sequence: Synthetic peptide
  Seed: RGFFYTPKTR (INS_HUMAN)
RMFFYTPKTK

SEQ ID NO: 34194 - protein, 9 aa, Artificial Sequence
  Description of Artificial Sequence: Synthetic peptide
  Seed: RLLPLLALL (INS_HUMAN)
RMLPLLALL

SEQ ID NO: 34195 - protein, 9 aa, Artificial Sequence
  Description of Artificial Sequence: Synthetic peptide
  Seed: RLLPLLALL (INS_HUMAN)
RRLPLLALL

SEQ ID NO: 34196 - protein, 10 aa, Artificial Sequence
  Description of Artificial Sequence: Synthetic peptide
  Seed: RGFFYTPKTR (INS_HUMAN)
RTFFYTPKTK

SEQ ID NO: 34197 - protein, 9 aa, Artificial Sequence
  Description of Artificial Sequence: Synthetic peptide
  Seed: RLLPLLALL (INS_HUMAN)
RTLPLLALL

SEQ ID NO: 34198 - protein, 9 aa, Artificial Sequence
  Description of Artificial Sequence: Synthetic peptide
  Seed: TSICSLYQL (INS_HUMAN)
TAICSLYQL

SEQ ID NO: 34199 - protein, 9 aa, Artificial Sequence
  Description of Artificial Sequence: Synthetic peptide
  Seed: TSICSLYQL (INS_HUMAN)
TTICSLYQF

SEQ ID NO: 34200 - protein, 9 aa, Artificial Sequence
  Description of Artificial Sequence: Synthetic peptide
  Seed: WGPDPAAAF (INS_HUMAN)
WAPDPAAAL

SEQ ID NO: 34201 - protein, 9 aa, Artificial Sequence
  Description of Artificial Sequence: Synthetic peptide
  Seed: WGPDPAAAF (INS_HUMAN)
WAPDPAAAM

SEQ ID NO: 34202 - protein, 9 aa, Artificial Sequence
  Description of Artificial Sequence: Synthetic peptide
  Seed: WGPDPAAAF (INS_HUMAN)
WFPDPAAAL

SEQ ID NO: 34203 - protein, 9 aa, Artificial Sequence
  Description of Artificial Sequence: Synthetic peptide
  Seed: WGPDPAAAF (INS_HUMAN)
WMPDPAAAM

SEQ ID NO: 34204 - protein, 9 aa, Artificial Sequence
  Description of Artificial Sequence: Synthetic peptide
  Seed: YLVCGERGF (INS_HUMAN)
YMVCGERGY

SEQ ID NO: 34205 - protein, 9 aa, Homo sapiens
  Native (INS_HUMAN)
AAAFVNQHL

SEQ ID NO: 34206 - protein, 11 aa, Homo sapiens
  Native (INS_HUMAN)
AEDLQVGQVEL

SEQ ID NO: 34207 - protein, 11 aa, Homo sapiens
  Native (INS_HUMAN)
ALWGPDPAAAF

SEQ ID NO: 34208 - protein, 9 aa, Homo sapiens
  Native (INS_HUMAN)
ALWMRLLPL

SEQ ID NO: 34209 - protein, 10 aa, Homo sapiens
  Native (INS_HUMAN)
EALYLVCGER

SEQ ID NO: 34210 - protein, 9 aa, Homo sapiens
  Native (INS_HUMAN)
FFYTPKTRR

SEQ ID NO: 34211 - protein, 9 aa, Homo sapiens
  Native (INS_HUMAN)
GERGFFYTP

SEQ ID NO: 34212 - protein, 10 aa, Homo sapiens
  Native (INS_HUMAN)
GPGAGSLQPL

SEQ ID NO: 34213 - protein, 9 aa, Homo sapiens
  Native (INS_HUMAN)
GSHLVEALY

SEQ ID NO: 34214 - protein, 9 aa, Homo sapiens
  Native (INS_HUMAN)
HLVEALYLV

SEQ ID NO: 34215 - protein, 9 aa, Homo sapiens
  Native (INS_HUMAN)
LALEGSLQK

SEQ ID NO: 34216 - protein, 9 aa, Homo sapiens
  Native (INS_HUMAN)
LPLLALLAL

SEQ ID NO: 34217 - protein, 10 aa, Homo sapiens
  Native (INS_HUMAN)
LPLLALLALW

SEQ ID NO: 34218 - protein, 10 aa, Homo sapiens
  Native (INS_HUMAN)
LWGPDPAAAF

SEQ ID NO: 34219 - protein, 9 aa, Homo sapiens
  Native (INS_HUMAN)
MRLLPLLAL

SEQ ID NO: 34220 - protein, 9 aa, Homo sapiens
  Native (INS_HUMAN)
QHLCGSHLV

SEQ ID NO: 34221 - protein, 11 aa, Homo sapiens
  Native (INS_HUMAN)
REAEDLQVGQV

SEQ ID NO: 34222 - protein, 9 aa, Homo sapiens
  Native (INS_HUMAN)
RLLPLLALL

SEQ ID NO: 34223 - protein, 9 aa, Homo sapiens
  Native (INS_HUMAN)
VELGGGPGA

SEQ ID NO: 34224 - protein, 11 aa, Homo sapiens
  Native (INS_HUMAN)
YLVCGERGFFY

SEQ ID NO: 34225 - protein, 9 aa, Artificial Sequence
  Description of Artificial Sequence: Synthetic peptide
  Seed: AAAFVNQHL (INS_HUMAN)
ALAFVNQHI

SEQ ID NO: 34226 - protein, 9 aa, Artificial Sequence
  Description of Artificial Sequence: Synthetic peptide
  Seed: MRLLPLLAL (INS_HUMAN)
MSLLPLLAY

SEQ ID NO: 34227 - protein, 10 aa, Artificial Sequence
  Description of Artificial Sequence: Synthetic peptide
  Seed: LALWGPDPAA (INS_HUMAN)
LFLWGPDPAL

SEQ ID NO: 34228 - protein, 8 aa, Artificial Sequence
  Description of Artificial Sequence: Synthetic peptide
  Seed: LWMRLLPL (INS_HUMAN)
LLMRLLPI

SEQ ID NO: 34229 - protein, 9 aa, Artificial Sequence
  Description of Artificial Sequence: Synthetic peptide
  Seed: GPDPAAAFV (INS_HUMAN)
GCDPAAAFL

SEQ ID NO: 34230 - protein, 9 aa, Artificial Sequence
  Description of Artificial Sequence: Synthetic peptide
  Seed: GPDPAAAFV (INS_HUMAN)
GYDPAAAFM

SEQ ID NO: 34231 - protein, 11 aa, Artificial Sequence
  Description of Artificial Sequence: Synthetic peptide
  Seed: GSHLVEALYLV (INS_HUMAN)
GPHLVEALYLL

SEQ ID NO: 34232 - protein, 9 aa, Artificial Sequence
  Description of Artificial Sequence: Synthetic peptide
  Seed: MRLLPLLAL (INS_HUMAN)
MYLLPLLAL

SEQ ID NO: 34233 - protein, 11 aa, Artificial Sequence
  Description of Artificial Sequence: Synthetic peptide
  Seed: WMRLLPLLALL (INS_HUMAN)
WGRLLPLLALL

SEQ ID NO: 34234 - protein, 10 aa, Artificial Sequence
  Description of Artificial Sequence: Synthetic peptide
  Seed: LLPLLALLAL (INS_HUMAN)
LSPLLALLAY

SEQ ID NO: 34235 - protein, 9 aa, Artificial Sequence
  Description of Artificial Sequence: Synthetic peptide
  Seed: YTPKTRREA (INS_HUMAN)
YAPKTRREL

SEQ ID NO: 34236 - protein, 9 aa, Artificial Sequence
  Description of Artificial Sequence: Synthetic peptide
  Seed: REAEDLQVG (INS_HUMAN)
RDAEDLQVL

SEQ ID NO: 34237 - protein, 11 aa, Artificial Sequence
  Description of Artificial Sequence: Synthetic peptide
  Seed: RGFFYTPKTRR (INS_HUMAN)
RIFFYTPKTRR

SEQ ID NO: 34238 - protein, 9 aa, Artificial Sequence
  Description of Artificial Sequence: Synthetic peptide
  Seed: AAAFVNQHL (INS_HUMAN)
AIAFVNQHY

SEQ ID NO: 34239 - protein, 8 aa, Artificial Sequence
  Description of Artificial Sequence: Synthetic peptide
  Seed: GPDPAAAF (INS_HUMAN)
GADPAAAM

SEQ ID NO: 34240 - protein, 9 aa, Artificial Sequence
  Description of Artificial Sequence: Synthetic peptide
  Seed: MRLLPLLAL (INS_HUMAN)
MLLLPLLAY

SEQ ID NO: 34241 - protein, 9 aa, Artificial Sequence
  Description of Artificial Sequence: Synthetic peptide
  Seed: HLVEALYLV (INS_HUMAN)
HMVEALYLA

SEQ ID NO: 34242 - protein, 10 aa, Artificial Sequence
  Description of Artificial Sequence: Synthetic peptide
  Seed: SHLVEALYLV (INS_HUMAN)
SLLVEALYLV

SEQ ID NO: 34243 - protein, 11 aa, Artificial Sequence
  Description of Artificial Sequence: Synthetic peptide
  Seed: ALWGPDPAAAF (INS_HUMAN)
ALWGPDPAAAV

SEQ ID NO: 34244 - protein, 9 aa, Artificial Sequence
  Description of Artificial Sequence: Synthetic peptide
  Seed: LALWGPDPA (INS_HUMAN)
LALWGPDPM

SEQ ID NO: 34245 - protein, 9 aa, Artificial Sequence
  Description of Artificial Sequence: Synthetic peptide
  Seed: RLLPLLALL (INS_HUMAN)
RALPLLALK

SEQ ID NO: 34246 - protein, 9 aa, Artificial Sequence
  Description of Artificial Sequence: Synthetic peptide
  Seed: LWMRLLPLL (INS_HUMAN)
LSMRLLPLY

SEQ ID NO: 34247 - protein, 9 aa, Artificial Sequence
  Description of Artificial Sequence: Synthetic peptide
  Seed: CSLYQLENY (INS_HUMAN)
CALYQLENW

SEQ ID NO: 34248 - protein, 11 aa, Artificial Sequence
  Description of Artificial Sequence: Synthetic peptide
  Seed: YLVCGERGFFY (INS_HUMAN)
YYVCGERGFFY

SEQ ID NO: 34249 - protein, 10 aa, Artificial Sequence
  Description of Artificial Sequence: Synthetic peptide
  Seed: LLPLLALLAL (INS_HUMAN)
LPPLLALLAL

SEQ ID NO: 34250 - protein, 11 aa, Artificial Sequence
  Description of Artificial Sequence: Synthetic peptide
  Seed: WMRLLPLLALL (INS_HUMAN)
WQRLLPLLALV

SEQ ID NO: 34251 - protein, 10 aa, Artificial Sequence
  Description of Artificial Sequence: Synthetic peptide
  Seed: WMRLLPLLAL (INS_HUMAN)
WRRLLPLLAM

SEQ ID NO: 34252 - protein, 11 aa, Artificial Sequence
  Description of Artificial Sequence: Synthetic peptide
  Seed: REAEDLQVGQV (INS_HUMAN)
RVAEDLQVGQF

SEQ ID NO: 34253 - protein, 8 aa, Artificial Sequence
  Description of Artificial Sequence: Synthetic peptide
  Seed: RGFFYTPK (INS_HUMAN)
RQFFYTPR

SEQ ID NO: 34254 - protein, 10 aa, Artificial Sequence
  Description of Artificial Sequence: Synthetic peptide
  Seed: LLPLLALLAL (INS_HUMAN)
LNPLLALLAY

SEQ ID NO: 34255 - protein, 9 aa, Artificial Sequence
  Description of Artificial Sequence: Synthetic peptide
  Seed: VELGGGPGA (INS_HUMAN)
VELGGGPGV

SEQ ID NO: 34256 - protein, 9 aa, Artificial Sequence
  Description of Artificial Sequence: Synthetic peptide
  Seed: GPDPAAAFV (INS_HUMAN)
GSDPAAAFI

SEQ ID NO: 34257 - protein, 9 aa, Artificial Sequence
  Description of Artificial Sequence: Synthetic peptide
  Seed: VCGERGFFY (INS_HUMAN)
VLGERGFFY

SEQ ID NO: 34258 - protein, 9 aa, Artificial Sequence
  Description of Artificial Sequence: Synthetic peptide
  Seed: AGSLQPLAL (INS_HUMAN)
AMSLQPLAF

SEQ ID NO: 34259 - protein, 10 aa, Artificial Sequence
  Description of Artificial Sequence: Synthetic peptide
  Seed: RLLPLLALLA (INS_HUMAN)
RLLPLLALLY

SEQ ID NO: 34260 - protein, 8 aa, Artificial Sequence
  Description of Artificial Sequence: Synthetic peptide
  Seed: REAEDLQV (INS_HUMAN)
REAEDLQM

SEQ ID NO: 34261 - protein, 10 aa, Artificial Sequence
  Description of Artificial Sequence: Synthetic peptide
  Seed: MALWMRLLPL (INS_HUMAN)
MWLWMRLLPM

SEQ ID NO: 34262 - protein, 10 aa, Artificial Sequence
  Description of Artificial Sequence: Synthetic peptide
  Seed: MALWMRLLPL (INS_HUMAN)
MILWMRLLPA

SEQ ID NO: 34263 - protein, 9 aa, Artificial Sequence
  Description of Artificial Sequence: Synthetic peptide
  Seed: RLLPLLALL (INS_HUMAN)
RWLPLLALV

SEQ ID NO: 34264 - protein, 9 aa, Artificial Sequence
  Description of Artificial Sequence: Synthetic peptide
  Seed: RLLPLLALL (INS_HUMAN)
RGLPLLALW

SEQ ID NO: 34265 - protein, 9 aa, Artificial Sequence
  Description of Artificial Sequence: Synthetic peptide
  Seed: CSLYQLENY (INS_HUMAN)
CTLYQLENF

SEQ ID NO: 34266 - protein, 8 aa, Artificial Sequence
  Description of Artificial Sequence: Synthetic peptide
  Seed: LVEALYLV (INS_HUMAN)
LFEALYLV

SEQ ID NO: 34267 - protein, 10 aa, Artificial Sequence
  Description of Artificial Sequence: Synthetic peptide
  Seed: WGPDPAAAFV (INS_HUMAN)
WMPDPAAAFM

SEQ ID NO: 34268 - protein, 9 aa, Artificial Sequence
  Description of Artificial Sequence: Synthetic peptide
  Seed: HLVEALYLV (INS_HUMAN)
HLVEALYLM

SEQ ID NO: 34269 - protein, 9 aa, Artificial Sequence
  Description of Artificial Sequence: Synthetic peptide
  Seed: YTPKTRREA (INS_HUMAN)
YSPKTRREM

SEQ ID NO: 34270 - protein, 10 aa, Artificial Sequence
  Description of Artificial Sequence: Synthetic peptide
  Seed: LGGGPGAGSL (INS_HUMAN)
LAGGPGAGSM

SEQ ID NO: 34271 - protein, 9 aa, Artificial Sequence
  Description of Artificial Sequence: Synthetic peptide
  Seed: RLLPLLALL (INS_HUMAN)
RLLPLLALY

SEQ ID NO: 34272 - protein, 9 aa, Artificial Sequence
  Description of Artificial Sequence: Synthetic peptide
  Seed: LALEGSLQK (INS_HUMAN)
LALEGSLQI

SEQ ID NO: 34273 - protein, 8 aa, Artificial Sequence
  Description of Artificial Sequence: Synthetic peptide
  Seed: REAEDLQV (INS_HUMAN)
REAEDLQL

SEQ ID NO: 34274 - protein, 11 aa, Artificial Sequence
  Description of Artificial Sequence: Synthetic peptide
  Seed: RGFFYTPKTRR (INS_HUMAN)
RQFFYTPKTRR

SEQ ID NO: 34275 - protein, 10 aa, Artificial Sequence
  Description of Artificial Sequence: Synthetic peptide
  Seed: MRLLPLLALL (INS_HUMAN)
MHLLPLLALV

SEQ ID NO: 34276 - protein, 9 aa, Artificial Sequence
  Description of Artificial Sequence: Synthetic peptide
  Seed: VCGERGFFY (INS_HUMAN)
VWGERGFFY

SEQ ID NO: 34277 - protein, 9 aa, Artificial Sequence
  Description of Artificial Sequence: Synthetic peptide
  Seed: MRLLPLLAL (INS_HUMAN)
MVLLPLLAY

SEQ ID NO: 34278 - protein, 9 aa, Artificial Sequence
  Description of Artificial Sequence: Synthetic peptide
  Seed: AEDLQVGQV (INS_HUMAN)
AMDLQVGQF

SEQ ID NO: 34279 - protein, 11 aa, Artificial Sequence
  Description of Artificial Sequence: Synthetic peptide
  Seed: GSHLVEALYLV (INS_HUMAN)
GIHLVEALYLV

SEQ ID NO: 34280 - protein, 9 aa, Artificial Sequence
  Description of Artificial Sequence: Synthetic peptide
  Seed: YLVCGERGF (INS_HUMAN)
YKVCGERGF

SEQ ID NO: 34281 - protein, 10 aa, Artificial Sequence
  Description of Artificial Sequence: Synthetic peptide
  Seed: HLVEALYLVC (INS_HUMAN)
HMVEALYLVC

SEQ ID NO: 34282 - protein, 11 aa, Artificial Sequence
  Description of Artificial Sequence: Synthetic peptide
  Seed: GQVELGGGPGA (INS_HUMAN)
GEVELGGGPGT

SEQ ID NO: 34283 - protein, 10 aa, Artificial Sequence
  Description of Artificial Sequence: Synthetic peptide
  Seed: SHLVEALYLV (INS_HUMAN)
SPLVEALYLI

SEQ ID NO: 34284 - protein, 9 aa, Artificial Sequence
  Description of Artificial Sequence: Synthetic peptide
  Seed: RLLPLLALL (INS_HUMAN)
RQLPLLALI

SEQ ID NO: 34285 - protein, 10 aa, Artificial Sequence
  Description of Artificial Sequence: Synthetic peptide
  Seed: LLALWGPDPA (INS_HUMAN)
LMALWGPDPV

SEQ ID NO: 34286 - protein, 9 aa, Artificial Sequence
  Description of Artificial Sequence: Synthetic peptide
  Seed: ALEGSLQKR (INS_HUMAN)
AIEGSLQKY

SEQ ID NO: 34287 - protein, 10 aa, Artificial Sequence
  Description of Artificial Sequence: Synthetic peptide
  Seed: LLPLLALLAL (INS_HUMAN)
LKPLLALLAL

SEQ ID NO: 34288 - protein, 9 aa, Artificial Sequence
  Description of Artificial Sequence: Synthetic peptide
  Seed: ALWGPDPAA (INS_HUMAN)
AIWGPDPAR

SEQ ID NO: 34289 - protein, 8 aa, Artificial Sequence
  Description of Artificial Sequence: Synthetic peptide
  Seed: AAFVNQHL (INS_HUMAN)
AQFVNQHV

SEQ ID NO: 34290 - protein, 10 aa, Artificial Sequence
  Description of Artificial Sequence: Synthetic peptide
  Seed: EALYLVCGER (INS_HUMAN)
ETLYLVCGEK

SEQ ID NO: 34291 - protein, 9 aa, Artificial Sequence
  Description of Artificial Sequence: Synthetic peptide
  Seed: WGPDPAAAF (INS_HUMAN)
WSPDPAAAM

SEQ ID NO: 34292 - protein, 10 aa, Artificial Sequence
  Description of Artificial Sequence: Synthetic peptide
  Seed: LLPLLALLAL (INS_HUMAN)
LVPLLALLAY

SEQ ID NO: 34293 - protein, 9 aa, Artificial Sequence
  Description of Artificial Sequence: Synthetic peptide
  Seed: GPDPAAAFV (INS_HUMAN)
GWDPAAAFL

SEQ ID NO: 34294 - protein, 9 aa, Artificial Sequence
  Description of Artificial Sequence: Synthetic peptide
  Seed: GPDPAAAFV (INS_HUMAN)
GFDPAAAFI

SEQ ID NO: 34295 - protein, 10 aa, Artificial Sequence
  Description of Artificial Sequence: Synthetic peptide
  Seed: ALWGPDPAAA (INS_HUMAN)
AMWGPDPAAM

SEQ ID NO: 34296 - protein, 10 aa, Artificial Sequence
  Description of Artificial Sequence: Synthetic peptide
  Seed: MRLLPLLALL (INS_HUMAN)
MWLLPLLALL

SEQ ID NO: 34297 - protein, 10 aa, Artificial Sequence
  Description of Artificial Sequence: Synthetic peptide
  Seed: HLCGSHLVEA (INS_HUMAN)
HLCGSHLVEL

SEQ ID NO: 34298 - protein, 9 aa, Artificial Sequence
  Description of Artificial Sequence: Synthetic peptide
  Seed: AAFVNQHLC (INS_HUMAN)
AGFVNQHLW

SEQ ID NO: 34299 - protein, 11 aa, Artificial Sequence
  Description of Artificial Sequence: Synthetic peptide
  Seed: REAEDLQVGQV (INS_HUMAN)
RIAEDLQVGQW

SEQ ID NO: 34300 - protein, 10 aa, Artificial Sequence
  Description of Artificial Sequence: Synthetic peptide
  Seed: WMRLLPLLAL (INS_HUMAN)
WWRLLPLLAL

SEQ ID NO: 34301 - protein, 9 aa, Artificial Sequence
  Description of Artificial Sequence: Synthetic peptide
  Seed: VCGERGFFY (INS_HUMAN)
VTGERGFFY

SEQ ID NO: 34302 - protein, 9 aa, Artificial Sequence
  Description of Artificial Sequence: Synthetic peptide
  Seed: ALWMRLLPL (INS_HUMAN)
AQWMRLLPY

SEQ ID NO: 34303 - protein, 9 aa, Artificial Sequence
  Description of Artificial Sequence: Synthetic peptide
  Seed: MALWMRLLP (INS_HUMAN)
MPLWMRLLV

SEQ ID NO: 34304 - protein, 9 aa, Artificial Sequence
  Description of Artificial Sequence: Synthetic peptide
  Seed: AAAFVNQHL (INS_HUMAN)
AMAFVNQHY

SEQ ID NO: 34305 - protein, 10 aa, Artificial Sequence
  Description of Artificial Sequence: Synthetic peptide
  Seed: ALWGPDPAAA (INS_HUMAN)
AVWGPDPAAK

SEQ ID NO: 34306 - protein, 9 aa, Artificial Sequence
  Description of Artificial Sequence: Synthetic peptide
  Seed: TSICSLYQL (INS_HUMAN)
TGICSLYQW

SEQ ID NO: 34307 - protein, 9 aa, Artificial Sequence
  Description of Artificial Sequence: Synthetic peptide
  Seed: MALWMRLLP (INS_HUMAN)
MPLWMRLLI

SEQ ID NO: 34308 - protein, 11 aa, Artificial Sequence
  Description of Artificial Sequence: Synthetic peptide
  Seed: REAEDLQVGQV (INS_HUMAN)
REAEDLQVGQL

SEQ ID NO: 34309 - protein, 10 aa, Artificial Sequence
  Description of Artificial Sequence: Synthetic peptide
  Seed: LLPLLALLAL (INS_HUMAN)
LLPLLALLAV

SEQ ID NO: 34310 - protein, 11 aa, Artificial Sequence
  Description of Artificial Sequence: Synthetic peptide
  Seed: ALWGPDPAAAF (INS_HUMAN)
AMWGPDPAAAM

SEQ ID NO: 34311 - protein, 9 aa, Artificial Sequence
  Description of Artificial Sequence: Synthetic peptide
  Seed: AEDLQVGQV (INS_HUMAN)
ACDLQVGQL

SEQ ID NO: 34312 - protein, 10 aa, Artificial Sequence
  Description of Artificial Sequence: Synthetic peptide
  Seed: RGFFYTPKTR (INS_HUMAN)
RMFFYTPKTR

SEQ ID NO: 34313 - protein, 9 aa, Artificial Sequence
  Description of Artificial Sequence: Synthetic peptide
  Seed: MRLLPLLAL (INS_HUMAN)
MKLLPLLAL

SEQ ID NO: 34314 - protein, 9 aa, Artificial Sequence
  Description of Artificial Sequence: Synthetic peptide
  Seed: RLLPLLALL (INS_HUMAN)
RTLPLLALY

SEQ ID NO: 34315 - protein, 10 aa, Artificial Sequence
  Description of Artificial Sequence: Synthetic peptide
  Seed: WMRLLPLLAL (INS_HUMAN)
WFRLLPLLAL

SEQ ID NO: 34316 - protein, 10 aa, Artificial Sequence
  Description of Artificial Sequence: Synthetic peptide
  Seed: WMRLLPLLAL (INS_HUMAN)
WSRLLPLLAY

SEQ ID NO: 34317 - protein, 11 aa, Artificial Sequence
  Description of Artificial Sequence: Synthetic peptide
  Seed: WMRLLPLLALL (INS_HUMAN)
WFRLLPLLALL

SEQ ID NO: 34318 - protein, 10 aa, Artificial Sequence
  Description of Artificial Sequence: Synthetic peptide
  Seed: RGFFYTPKTR (INS_HUMAN)
RCFFYTPKTR

SEQ ID NO: 34319 - protein, 8 aa, Artificial Sequence
  Description of Artificial Sequence: Synthetic peptide
  Seed: HLVEALYL (INS_HUMAN)
HQVEALYI

SEQ ID NO: 34320 - protein, 9 aa, Artificial Sequence
  Description of Artificial Sequence: Synthetic peptide
  Seed: GPDPAAAFV (INS_HUMAN)
GYDPAAAFF

SEQ ID NO: 34321 - protein, 11 aa, Artificial Sequence
  Description of Artificial Sequence: Synthetic peptide
  Seed: WMRLLPLLALL (INS_HUMAN)
WNRLLPLLALL

SEQ ID NO: 34322 - protein, 9 aa, Artificial Sequence
  Description of Artificial Sequence: Synthetic peptide
  Seed: ALWMRLLPL (INS_HUMAN)
APWMRLLPF

SEQ ID NO: 34323 - protein, 10 aa, Artificial Sequence
  Description of Artificial Sequence: Synthetic peptide
  Seed: WMRLLPLLAL (INS_HUMAN)
WSRLLPLLAM

SEQ ID NO: 34324 - protein, 9 aa, Artificial Sequence
  Description of Artificial Sequence: Synthetic peptide
  Seed: FVNQHLCGS (INS_HUMAN)
FANQHLCGI

SEQ ID NO: 34325 - protein, 9 aa, Artificial Sequence
  Description of Artificial Sequence: Synthetic peptide
  Seed: GERGFFYTP (INS_HUMAN)
GERGFFYTM

SEQ ID NO: 34326 - protein, 10 aa, Artificial Sequence
  Description of Artificial Sequence: Synthetic peptide
  Seed: MALWMRLLPL (INS_HUMAN)
MPLWMRLLPM

SEQ ID NO: 34327 - protein, 10 aa, Artificial Sequence
  Description of Artificial Sequence: Synthetic peptide
  Seed: MALWMRLLPL (INS_HUMAN)
MKLWMRLLPV

SEQ ID NO: 34328 - protein, 10 aa, Artificial Sequence
  Description of Artificial Sequence: Synthetic peptide
  Seed: ALWMRLLPLL (INS_HUMAN)
AYWMRLLPLI

SEQ ID NO: 34329 - protein, 10 aa, Artificial Sequence
  Description of Artificial Sequence: Synthetic peptide
  Seed: WMRLLPLLAL (INS_HUMAN)
WHRLLPLLAI

SEQ ID NO: 34330 - protein, 10 aa, Artificial Sequence
  Description of Artificial Sequence: Synthetic peptide
  Seed: WMRLLPLLAL (INS_HUMAN)
WHRLLPLLAM

SEQ ID NO: 34331 - protein, 9 aa, Artificial Sequence
  Description of Artificial Sequence: Synthetic peptide
  Seed: WGPDPAAAF (INS_HUMAN)
WAPDPAAAH

SEQ ID NO: 34332 - protein, 11 aa, Artificial Sequence
  Description of Artificial Sequence: Synthetic peptide
  Seed: REAEDLQVGQV (INS_HUMAN)
RQAEDLQVGQV

SEQ ID NO: 34333 - protein, 9 aa, Artificial Sequence
  Description of Artificial Sequence: Synthetic peptide
  Seed: ALWMRLLPL (INS_HUMAN)
ALWMRLLPY

SEQ ID NO: 34334 - protein, 9 aa, Artificial Sequence
  Description of Artificial Sequence: Synthetic peptide
  Seed: RLLPLLALL (INS_HUMAN)
RELPLLALV

SEQ ID NO: 34335 - protein, 9 aa, Artificial Sequence
  Description of Artificial Sequence: Synthetic peptide
  Seed: HLVEALYLV (INS_HUMAN)
HSVEALYLA

SEQ ID NO: 34336 - protein, 9 aa, Artificial Sequence
  Description of Artificial Sequence: Synthetic peptide
  Seed: ALWMRLLPL (INS_HUMAN)
AHWMRLLPY

SEQ ID NO: 34337 - protein, 10 aa, Artificial Sequence
  Description of Artificial Sequence: Synthetic peptide
  Seed: MALWMRLLPL (INS_HUMAN)
MYLWMRLLPI

SEQ ID NO: 34338 - protein, 10 aa, Artificial Sequence
  Description of Artificial Sequence: Synthetic peptide
  Seed: VNQHLCGSHL (INS_HUMAN)
VSQHLCGSHY

SEQ ID NO: 34339 - protein, 9 aa, Artificial Sequence
  Description of Artificial Sequence: Synthetic peptide
  Seed: YLVCGERGF (INS_HUMAN)
YSVCGERGY

SEQ ID NO: 34340 - protein, 9 aa, Artificial Sequence
  Description of Artificial Sequence: Synthetic peptide
  Seed: DLQVGQVEL (INS_HUMAN)
DMQVGQVEF

SEQ ID NO: 34341 - protein, 9 aa, Artificial Sequence
  Description of Artificial Sequence: Synthetic peptide
  Seed: FVNQHLCGS (INS_HUMAN)
FVNQHLCGV

SEQ ID NO: 34342 - protein, 9 aa, Artificial Sequence
  Description of Artificial Sequence: Synthetic peptide
  Seed: FFYTPKTRR (INS_HUMAN)
FIYTPKTRK

SEQ ID NO: 34343 - protein, 9 aa, Artificial Sequence
  Description of Artificial Sequence: Synthetic peptide
  Seed: HLVEALYLV (INS_HUMAN)
HSVEALYLV

SEQ ID NO: 34344 - protein, 11 aa, Artificial Sequence
  Description of Artificial Sequence: Synthetic peptide
  Seed: GQVELGGGPGA (INS_HUMAN)
GEVELGGGPGI

SEQ ID NO: 34345 - protein, 9 aa, Artificial Sequence
  Description of Artificial Sequence: Synthetic peptide
  Seed: GERGFFYTP (INS_HUMAN)
GERGFFYTL

SEQ ID NO: 34346 - protein, 10 aa, Artificial Sequence
  Description of Artificial Sequence: Synthetic peptide
  Seed: SHLVEALYLV (INS_HUMAN)
SKLVEALYLL

SEQ ID NO: 34347 - protein, 11 aa, Artificial Sequence
  Description of Artificial Sequence: Synthetic peptide
  Seed: MALWMRLLPLL (INS_HUMAN)
MTLWMRLLPLW

SEQ ID NO: 34348 - protein, 9 aa, Artificial Sequence
  Description of Artificial Sequence: Synthetic peptide
  Seed: RLLPLLALL (INS_HUMAN)
RVLPLLALL

SEQ ID NO: 34349 - protein, 9 aa, Artificial Sequence
  Description of Artificial Sequence: Synthetic peptide
  Seed: AGSLQPLAL (INS_HUMAN)
ATSLQPLAM

SEQ ID NO: 34350 - protein, 9 aa, Artificial Sequence
  Description of Artificial Sequence: Synthetic peptide
  Seed: AAAFVNQHL (INS_HUMAN)
AAAFVNQHY

SEQ ID NO: 34351 - protein, 10 aa, Artificial Sequence
  Description of Artificial Sequence: Synthetic peptide
  Seed: RGFFYTPKTR (INS_HUMAN)
RSFFYTPKTK

SEQ ID NO: 34352 - protein, 11 aa, Artificial Sequence
  Description of Artificial Sequence: Synthetic peptide
  Seed: SHLVEALYLVC (INS_HUMAN)
SLLVEALYLVE

SEQ ID NO: 34353 - protein, 9 aa, Artificial Sequence
  Description of Artificial Sequence: Synthetic peptide
  Seed: WGPDPAAAF (INS_HUMAN)
WYPDPAAAV

SEQ ID NO: 34354 - protein, 10 aa, Artificial Sequence
  Description of Artificial Sequence: Synthetic peptide
  Seed: ICSLYQLENY (INS_HUMAN)
ISSLYQLENW

SEQ ID NO: 34355 - protein, 9 aa, Artificial Sequence
  Description of Artificial Sequence: Synthetic peptide
  Seed: YTPKTRREA (INS_HUMAN)
YTPKTRREM

SEQ ID NO: 34356 - protein, 9 aa, Artificial Sequence
  Description of Artificial Sequence: Synthetic peptide
  Seed: ALWGPDPAA (INS_HUMAN)
AMWGPDPAA

SEQ ID NO: 34357 - protein, 9 aa, Artificial Sequence
  Description of Artificial Sequence: Synthetic peptide
  Seed: MRLLPLLAL (INS_HUMAN)
MYLLPLLAY

SEQ ID NO: 34358 - protein, 9 aa, Artificial Sequence
  Description of Artificial Sequence: Synthetic peptide
  Seed: AEDLQVGQV (INS_HUMAN)
AFDLQVGQL

SEQ ID NO: 34359 - protein, 9 aa, Artificial Sequence
  Description of Artificial Sequence: Synthetic peptide
  Seed: WGPDPAAAF (INS_HUMAN)
WTPDPAAAY

SEQ ID NO: 34360 - protein, 11 aa, Artificial Sequence
  Description of Artificial Sequence: Synthetic peptide
  Seed: MALWMRLLPLL (INS_HUMAN)
MKLWMRLLPLF

SEQ ID NO: 34361 - protein, 11 aa, Artificial Sequence
  Description of Artificial Sequence: Synthetic peptide
  Seed: SHLVEALYLVC (INS_HUMAN)
SMLVEALYLVH

SEQ ID NO: 34362 - protein, 10 aa, Artificial Sequence
  Description of Artificial Sequence: Synthetic peptide
  Seed: WMRLLPLLAL (INS_HUMAN)
WGRLLPLLAM

SEQ ID NO: 34363 - protein, 10 aa, Artificial Sequence
  Description of Artificial Sequence: Synthetic peptide
  Seed: SHLVEALYLV (INS_HUMAN)
SKLVEALYLI

SEQ ID NO: 34364 - protein, 9 aa, Artificial Sequence
  Description of Artificial Sequence: Synthetic peptide
  Seed: AGSLQPLAL (INS_HUMAN)
AASLQPLAM

SEQ ID NO: 34365 - protein, 9 aa, Artificial Sequence
  Description of Artificial Sequence: Synthetic peptide
  Seed: GPGAGSLQP (INS_HUMAN)
GPGAGSLQA

SEQ ID NO: 34366 - protein, 9 aa, Artificial Sequence
  Description of Artificial Sequence: Synthetic peptide
  Seed: AAFVNQHLC (INS_HUMAN)
ASFVNQHLI

SEQ ID NO: 34367 - protein, 9 aa, Artificial Sequence
  Description of Artificial Sequence: Synthetic peptide
  Seed: GPDPAAAFV (INS_HUMAN)
GNDPAAAFM

SEQ ID NO: 34368 - protein, 11 aa, Artificial Sequence
  Description of Artificial Sequence: Synthetic peptide
  Seed: MALWMRLLPLL (INS_HUMAN)
MMLWMRLLPLF

SEQ ID NO: 34369 - protein, 10 aa, Artificial Sequence
  Description of Artificial Sequence: Synthetic peptide
  Seed: MRLLPLLALL (INS_HUMAN)
MGLLPLLALA

SEQ ID NO: 34370 - protein, 10 aa, Artificial Sequence
  Description of Artificial Sequence: Synthetic peptide
  Seed: MRLLPLLALL (INS_HUMAN)
MLLLPLLALA

SEQ ID NO: 34371 - protein, 10 aa, Artificial Sequence
  Description of Artificial Sequence: Synthetic peptide
  Seed: HLVEALYLVC (INS_HUMAN)
HMVEALYLVQ

SEQ ID NO: 34372 - protein, 9 aa, Artificial Sequence
  Description of Artificial Sequence: Synthetic peptide
  Seed: RLLPLLALL (INS_HUMAN)
RSLPLLALM

SEQ ID NO: 34373 - protein, 9 aa, Artificial Sequence
  Description of Artificial Sequence: Synthetic peptide
  Seed: WGPDPAAAF (INS_HUMAN)
WYPDPAAAM

SEQ ID NO: 34374 - protein, 9 aa, Artificial Sequence
  Description of Artificial Sequence: Synthetic peptide
  Seed: WGPDPAAAF (INS_HUMAN)
WLPDPAAAI

SEQ ID NO: 34375 - protein, 11 aa, Artificial Sequence
  Description of Artificial Sequence: Synthetic peptide
  Seed: ALWGPDPAAAF (INS_HUMAN)
AGWGPDPAAAM

SEQ ID NO: 34376 - protein, 11 aa, Artificial Sequence
  Description of Artificial Sequence: Synthetic peptide
  Seed: ALWGPDPAAAF (INS_HUMAN)
AKWGPDPAAAY

SEQ ID NO: 34377 - protein, 10 aa, Artificial Sequence
  Description of Artificial Sequence: Synthetic peptide
  Seed: RLLPLLALLA (INS_HUMAN)
RLLPLLALLC

SEQ ID NO: 34378 - protein, 9 aa, Artificial Sequence
  Description of Artificial Sequence: Synthetic peptide
  Seed: FVNQHLCGS (INS_HUMAN)
FLNQHLCGA

SEQ ID NO: 34379 - protein, 10 aa, Artificial Sequence
  Description of Artificial Sequence: Synthetic peptide
  Seed: LLPLLALLAL (INS_HUMAN)
LIPLLALLAL

SEQ ID NO: 34380 - protein, 10 aa, Artificial Sequence
  Description of Artificial Sequence: Synthetic peptide
  Seed: MALWMRLLPL (INS_HUMAN)
MRLWMRLLPV

SEQ ID NO: 34381 - protein, 10 aa, Artificial Sequence
  Description of Artificial Sequence: Synthetic peptide
  Seed: SHLVEALYLV (INS_HUMAN)
SMLVEALYLI

SEQ ID NO: 34382 - protein, 9 aa, Artificial Sequence
  Description of Artificial Sequence: Synthetic peptide
  Seed: FVNQHLCGS (INS_HUMAN)
FTNQHLCGL

SEQ ID NO: 34383 - protein, 9 aa, Artificial Sequence
  Description of Artificial Sequence: Synthetic peptide
  Seed: AAAFVNQHL (INS_HUMAN)
AMAFVNQHM

SEQ ID NO: 34384 - protein, 8 aa, Artificial Sequence
  Description of Artificial Sequence: Synthetic peptide
  Seed: TPKTRREA (INS_HUMAN)
TPKTRREL

SEQ ID NO: 34385 - protein, 9 aa, Artificial Sequence
  Description of Artificial Sequence: Synthetic peptide
  Seed: AEDLQVGQV (INS_HUMAN)
AMDLQVGQV

SEQ ID NO: 34386 - protein, 9 aa, Artificial Sequence
  Description of Artificial Sequence: Synthetic peptide
  Seed: YTPKTRREA (INS_HUMAN)
YSPKTRREI

SEQ ID NO: 34387 - protein, 9 aa, Artificial Sequence
  Description of Artificial Sequence: Synthetic peptide
  Seed: QHLCGSHLV (INS_HUMAN)
QHLCGSHLF

SEQ ID NO: 34388 - protein, 9 aa, Artificial Sequence
  Description of Artificial Sequence: Synthetic peptide
  Seed: FFYTPKTRR (INS_HUMAN)
FTYTPKTRK

SEQ ID NO: 34389 - protein, 10 aa, Artificial Sequence
  Description of Artificial Sequence: Synthetic peptide
  Seed: RGFFYTPKTR (INS_HUMAN)
RLFFYTPKTK

SEQ ID NO: 34390 - protein, 9 aa, Artificial Sequence
  Description of Artificial Sequence: Synthetic peptide
  Seed: RLLPLLALL (INS_HUMAN)
RTLPLLALI

SEQ ID NO: 34391 - protein, 10 aa, Artificial Sequence
  Description of Artificial Sequence: Synthetic peptide
  Seed: WMRLLPLLAL (INS_HUMAN)
WQRLLPLLAM

SEQ ID NO: 34392 - protein, 10 aa, Artificial Sequence
  Description of Artificial Sequence: Synthetic peptide
  Seed: MALWMRLLPL (INS_HUMAN)
MELWMRLLPL

SEQ ID NO: 34393 - protein, 9 aa, Artificial Sequence
  Description of Artificial Sequence: Synthetic peptide
  Seed: REAEDLQVG (INS_HUMAN)
RQAEDLQVW

SEQ ID NO: 34394 - protein, 10 aa, Artificial Sequence
  Description of Artificial Sequence: Synthetic peptide
  Seed: MALWMRLLPL (INS_HUMAN)
MVLWMRLLPV

SEQ ID NO: 34395 - protein, 11 aa, Artificial Sequence
  Description of Artificial Sequence: Synthetic peptide
  Seed: WMRLLPLLALL (INS_HUMAN)
WRRLLPLLALV

SEQ ID NO: 34396 - protein, 9 aa, Artificial Sequence
  Description of Artificial Sequence: Synthetic peptide
  Seed: AAFVNQHLC (INS_HUMAN)
ASFVNQHLW

SEQ ID NO: 34397 - protein, 9 aa, Artificial Sequence
  Description of Artificial Sequence: Synthetic peptide
  Seed: VCGERGFFY (INS_HUMAN)
VVGERGFFY

SEQ ID NO: 34398 - protein, 9 aa, Artificial Sequence
  Description of Artificial Sequence: Synthetic peptide
  Seed: LALWGPDPA (INS_HUMAN)
LLLWGPDPA

SEQ ID NO: 34399 - protein, 11 aa, Artificial Sequence
  Description of Artificial Sequence: Synthetic peptide
  Seed: RLLPLLALLAL (INS_HUMAN)
RPLPLLALLAM

SEQ ID NO: 34400 - protein, 9 aa, Artificial Sequence
  Description of Artificial Sequence: Synthetic peptide
  Seed: NQHLCGSHL (INS_HUMAN)
NHHLCGSHI

SEQ ID NO: 34401 - protein, 9 aa, Artificial Sequence
  Description of Artificial Sequence: Synthetic peptide
  Seed: WGPDPAAAF (INS_HUMAN)
WRPDPAAAL

SEQ ID NO: 34402 - protein, 10 aa, Artificial Sequence
  Description of Artificial Sequence: Synthetic peptide
  Seed: MRLLPLLALL (INS_HUMAN)
MQLLPLLALL

SEQ ID NO: 34403 - protein, 11 aa, Artificial Sequence
  Description of Artificial Sequence: Synthetic peptide
  Seed: MALWMRLLPLL (INS_HUMAN)
MFLWMRLLPLV

SEQ ID NO: 34404 - protein, 10 aa, Artificial Sequence
  Description of Artificial Sequence: Synthetic peptide
  Seed: WMRLLPLLAL (INS_HUMAN)
WNRLLPLLAK

SEQ ID NO: 34405 - protein, 9 aa, Artificial Sequence
  Description of Artificial Sequence: Synthetic peptide
  Seed: GGGPGAGSL (INS_HUMAN)
GAGPGAGSF

SEQ ID NO: 34406 - protein, 9 aa, Artificial Sequence
  Description of Artificial Sequence: Synthetic peptide
  Seed: TSICSLYQL (INS_HUMAN)
TQICSLYQL

SEQ ID NO: 34407 - protein, 9 aa, Artificial Sequence
  Description of Artificial Sequence: Synthetic peptide
  Seed: ALWMRLLPL (INS_HUMAN)
APWMRLLPI

SEQ ID NO: 34408 - protein, 10 aa, Artificial Sequence
  Description of Artificial Sequence: Synthetic peptide
  Seed: LLPLLALLAL (INS_HUMAN)
LCPLLALLAL

SEQ ID NO: 34409 - protein, 9 aa, Artificial Sequence
  Description of Artificial Sequence: Synthetic peptide
  Seed: GPDPAAAFV (INS_HUMAN)
GTDPAAAFL

SEQ ID NO: 34410 - protein, 9 aa, Artificial Sequence
  Description of Artificial Sequence: Synthetic peptide
  Seed: RLLPLLALL (INS_HUMAN)
RSLPLLALY

SEQ ID NO: 34411 - protein, 9 aa, Artificial Sequence
  Description of Artificial Sequence: Synthetic peptide
  Seed: YTPKTRREA (INS_HUMAN)
YIPKTRREF

SEQ ID NO: 34412 - protein, 10 aa, Artificial Sequence
  Description of Artificial Sequence: Synthetic peptide
  Seed: MALWMRLLPL (INS_HUMAN)
MGLWMRLLPL

SEQ ID NO: 34413 - protein, 9 aa, Artificial Sequence
  Description of Artificial Sequence: Synthetic peptide
  Seed: WGPDPAAAF (INS_HUMAN)
WRPDPAAAY

SEQ ID NO: 34414 - protein, 10 aa, Artificial Sequence
  Description of Artificial Sequence: Synthetic peptide
  Seed: WMRLLPLLAL (INS_HUMAN)
WLRLLPLLAI

SEQ ID NO: 34415 - protein, 10 aa, Artificial Sequence
  Description of Artificial Sequence: Synthetic peptide
  Seed: WMRLLPLLAL (INS_HUMAN)
WSRLLPLLAK

SEQ ID NO: 34416 - protein, 9 aa, Artificial Sequence
  Description of Artificial Sequence: Synthetic peptide
  Seed: TSICSLYQL (INS_HUMAN)
TIICSLYQL

SEQ ID NO: 34417 - protein, 10 aa, Artificial Sequence
  Description of Artificial Sequence: Synthetic peptide
  Seed: MRLLPLLALL (INS_HUMAN)
MVLLPLLALL

SEQ ID NO: 34418 - protein, 11 aa, Artificial Sequence
  Description of Artificial Sequence: Synthetic peptide
  Seed: MALWMRLLPLL (INS_HUMAN)
MVLWMRLLPLV

SEQ ID NO: 34419 - protein, 9 aa, Artificial Sequence
  Description of Artificial Sequence: Synthetic peptide
  Seed: TSICSLYQL (INS_HUMAN)
TVICSLYQA

SEQ ID NO: 34420 - protein, 11 aa, Artificial Sequence
  Description of Artificial Sequence: Synthetic peptide
  Seed: GSHLVEALYLV (INS_HUMAN)
GDHLVEALYLV

SEQ ID NO: 34421 - protein, 10 aa, Artificial Sequence
  Description of Artificial Sequence: Synthetic peptide
  Seed: VNQHLCGSHL (INS_HUMAN)
VCQHLCGSHF

SEQ ID NO: 34422 - protein, 10 aa, Artificial Sequence
  Description of Artificial Sequence: Synthetic peptide
  Seed: GFFYTPKTRR (INS_HUMAN)
GTFYTPKTRR

SEQ ID NO: 34423 - protein, 10 aa, Artificial Sequence
  Description of Artificial Sequence: Synthetic peptide
  Seed: HLVEALYLVC (INS_HUMAN)
HMVEALYLVV

SEQ ID NO: 34424 - protein, 10 aa, Artificial Sequence
  Description of Artificial Sequence: Synthetic peptide
  Seed: HLCGSHLVEA (INS_HUMAN)
HMCGSHLVEL

SEQ ID NO: 34425 - protein, 8 aa, Artificial Sequence
  Description of Artificial Sequence: Synthetic peptide
  Seed: GSHLVEAL (INS_HUMAN)
GQHLVEAI

SEQ ID NO: 34426 - protein, 11 aa, Artificial Sequence
  Description of Artificial Sequence: Synthetic peptide
  Seed: GSHLVEALYLV (INS_HUMAN)
GKHLVEALYLL

SEQ ID NO: 34427 - protein, 10 aa, Artificial Sequence
  Description of Artificial Sequence: Synthetic peptide
  Seed: LALWGPDPAA (INS_HUMAN)
LYLWGPDPAV

SEQ ID NO: 34428 - protein, 9 aa, Artificial Sequence
  Description of Artificial Sequence: Synthetic peptide
  Seed: GSHLVEALY (INS_HUMAN)
GTHLVEALW

SEQ ID NO: 34429 - protein, 9 aa, Artificial Sequence
  Description of Artificial Sequence: Synthetic peptide
  Seed: RLLPLLALL (INS_HUMAN)
RRLPLLALM

SEQ ID NO: 34430 - protein, 11 aa, Artificial Sequence
  Description of Artificial Sequence: Synthetic peptide
  Seed: SHLVEALYLVC (INS_HUMAN)
SILVEALYLVV

SEQ ID NO: 34431 - protein, 11 aa, Artificial Sequence
  Description of Artificial Sequence: Synthetic peptide
  Seed: LWMRLLPLLAL (INS_HUMAN)
LYMRLLPLLAF

SEQ ID NO: 34432 - protein, 9 aa, Artificial Sequence
  Description of Artificial Sequence: Synthetic peptide
  Seed: YTPKTRREA (INS_HUMAN)
YIPKTRREL

SEQ ID NO: 34433 - protein, 10 aa, Artificial Sequence
  Description of Artificial Sequence: Synthetic peptide
  Seed: SHLVEALYLV (INS_HUMAN)
SGLVEALYLA

SEQ ID NO: 34434 - protein, 10 aa, Artificial Sequence
  Description of Artificial Sequence: Synthetic peptide
  Seed: RLLPLLALLA (INS_HUMAN)
RMLPLLALLT

SEQ ID NO: 34435 - protein, 9 aa, Artificial Sequence
  Description of Artificial Sequence: Synthetic peptide
  Seed: SHLVEALYL (INS_HUMAN)
SRLVEALYM

SEQ ID NO: 34436 - protein, 10 aa, Artificial Sequence
  Description of Artificial Sequence: Synthetic peptide
  Seed: WMRLLPLLAL (INS_HUMAN)
WSRLLPLLAI

SEQ ID NO: 34437 - protein, 10 aa, Artificial Sequence
  Description of Artificial Sequence: Synthetic peptide
  Seed: RGFFYTPKTR (INS_HUMAN)
RVFFYTPKTR

SEQ ID NO: 34438 - protein, 9 aa, Artificial Sequence
  Description of Artificial Sequence: Synthetic peptide
  Seed: HLVEALYLV (INS_HUMAN)
HNVEALYLV

SEQ ID NO: 34439 - protein, 9 aa, Artificial Sequence
  Description of Artificial Sequence: Synthetic peptide
  Seed: DLQVGQVEL (INS_HUMAN)
DMQVGQVEY

SEQ ID NO: 34440 - protein, 10 aa, Artificial Sequence
  Description of Artificial Sequence: Synthetic peptide
  Seed: MRLLPLLALL (INS_HUMAN)
MELLPLLALM

SEQ ID NO: 34441 - protein, 9 aa, Artificial Sequence
  Description of Artificial Sequence: Synthetic peptide
  Seed: RLLPLLALL (INS_HUMAN)
RYLPLLALF

SEQ ID NO: 34442 - protein, 10 aa, Artificial Sequence
  Description of Artificial Sequence: Synthetic peptide
  Seed: SHLVEALYLV (INS_HUMAN)
SPLVEALYLM

SEQ ID NO: 34443 - protein, 10 aa, Artificial Sequence
  Description of Artificial Sequence: Synthetic peptide
  Seed: ALWMRLLPLL (INS_HUMAN)
ALWMRLLPLI

SEQ ID NO: 34444 - protein, 9 aa, Artificial Sequence
  Description of Artificial Sequence: Synthetic peptide
  Seed: YTPKTRREA (INS_HUMAN)
YSPKTRREV

SEQ ID NO: 34445 - protein, 11 aa, Artificial Sequence
  Description of Artificial Sequence: Synthetic peptide
  Seed: SHLVEALYLVC (INS_HUMAN)
SLLVEALYLVC

SEQ ID NO: 34446 - protein, 10 aa, Artificial Sequence
  Description of Artificial Sequence: Synthetic peptide
  Seed: MALWMRLLPL (INS_HUMAN)
MSLWMRLLPL

SEQ ID NO: 34447 - protein, 11 aa, Artificial Sequence
  Description of Artificial Sequence: Synthetic peptide
  Seed: GSHLVEALYLV (INS_HUMAN)
GNHLVEALYLV

SEQ ID NO: 34448 - protein, 9 aa, Artificial Sequence
  Description of Artificial Sequence: Synthetic peptide
  Seed: AAAFVNQHL (INS_HUMAN)
ATAFVNQHF

SEQ ID NO: 34449 - protein, 9 aa, Artificial Sequence
  Description of Artificial Sequence: Synthetic peptide
  Seed: GPDPAAAFV (INS_HUMAN)
GSDPAAAFM

SEQ ID NO: 34450 - protein, 10 aa, Artificial Sequence
  Description of Artificial Sequence: Synthetic peptide
  Seed: LALEGSLQKR (INS_HUMAN)
LVLEGSLQKR

SEQ ID NO: 34451 - protein, 10 aa, Artificial Sequence
  Description of Artificial Sequence: Synthetic peptide
  Seed: MALWMRLLPL (INS_HUMAN)
MMLWMRLLPF

SEQ ID NO: 34452 - protein, 11 aa, Artificial Sequence
  Description of Artificial Sequence: Synthetic peptide
  Seed: ALWGPDPAAAF (INS_HUMAN)
AQWGPDPAAAW

SEQ ID NO: 34453 - protein, 10 aa, Artificial Sequence
  Description of Artificial Sequence: Synthetic peptide
  Seed: MALWMRLLPL (INS_HUMAN)
MRLWMRLLPL

SEQ ID NO: 34454 - protein, 9 aa, Artificial Sequence
  Description of Artificial Sequence: Synthetic peptide
  Seed: ALWMRLLPL (INS_HUMAN)
AMWMRLLPS

SEQ ID NO: 34455 - protein, 9 aa, Artificial Sequence
  Description of Artificial Sequence: Synthetic peptide
  Seed: AAFVNQHLC (INS_HUMAN)
AAFVNQHLI

SEQ ID NO: 34456 - protein, 9 aa, Artificial Sequence
  Description of Artificial Sequence: Synthetic peptide
  Seed: ALWMRLLPL (INS_HUMAN)
AIWMRLLPR

SEQ ID NO: 34457 - protein, 9 aa, Artificial Sequence
  Description of Artificial Sequence: Synthetic peptide
  Seed: SLYQLENYC (INS_HUMAN)
SLYQLENYI

SEQ ID NO: 34458 - protein, 9 aa, Artificial Sequence
  Description of Artificial Sequence: Synthetic peptide
  Seed: FVNQHLCGS (INS_HUMAN)
FTNQHLCGM

SEQ ID NO: 34459 - protein, 9 aa, Artificial Sequence
  Description of Artificial Sequence: Synthetic peptide
  Seed: GPDPAAAFV (INS_HUMAN)
GADPAAAFL

SEQ ID NO: 34460 - protein, 9 aa, Artificial Sequence
  Description of Artificial Sequence: Synthetic peptide
  Seed: YTPKTRREA (INS_HUMAN)
YVPKTRREF

SEQ ID NO: 34461 - protein, 10 aa, Artificial Sequence
  Description of Artificial Sequence: Synthetic peptide
  Seed: VNQHLCGSHL (INS_HUMAN)
VIQHLCGSHY

SEQ ID NO: 34462 - protein, 10 aa, Artificial Sequence
  Description of Artificial Sequence: Synthetic peptide
  Seed: LLPLLALLAL (INS_HUMAN)
LDPLLALLAL

SEQ ID NO: 34463 - protein, 11 aa, Artificial Sequence
  Description of Artificial Sequence: Synthetic peptide
  Seed: ALWGPDPAAAF (INS_HUMAN)
AQWGPDPAAAI

SEQ ID NO: 34464 - protein, 10 aa, Artificial Sequence
  Description of Artificial Sequence: Synthetic peptide
  Seed: HLVEALYLVC (INS_HUMAN)
HQVEALYLVV

SEQ ID NO: 34465 - protein, 9 aa, Artificial Sequence
  Description of Artificial Sequence: Synthetic peptide
  Seed: ALEGSLQKR (INS_HUMAN)
ASEGSLQKY

SEQ ID NO: 34466 - protein, 9 aa, Artificial Sequence
  Description of Artificial Sequence: Synthetic peptide
  Seed: WGPDPAAAF (INS_HUMAN)
WPPDPAAAI

SEQ ID NO: 34467 - protein, 11 aa, Artificial Sequence
  Description of Artificial Sequence: Synthetic peptide
  Seed: VELGGGPGAGS (INS_HUMAN)
VELGGGPGAGM

SEQ ID NO: 34468 - protein, 9 aa, Artificial Sequence
  Description of Artificial Sequence: Synthetic peptide
  Seed: TSICSLYQL (INS_HUMAN)
TAICSLYQY

SEQ ID NO: 34469 - protein, 9 aa, Artificial Sequence
  Description of Artificial Sequence: Synthetic peptide
  Seed: REAEDLQVG (INS_HUMAN)
REAEDLQVA

SEQ ID NO: 34470 - protein, 10 aa, Artificial Sequence
  Description of Artificial Sequence: Synthetic peptide
  Seed: WGPDPAAAFV (INS_HUMAN)
WMPDPAAAFL

SEQ ID NO: 34471 - protein, 9 aa, Artificial Sequence
  Description of Artificial Sequence: Synthetic peptide
  Seed: WGPDPAAAF (INS_HUMAN)
WSPDPAAAF

SEQ ID NO: 34472 - protein, 8 aa, Artificial Sequence
  Description of Artificial Sequence: Synthetic peptide
  Seed: LWMRLLPL (INS_HUMAN)
LLMRLLPV

SEQ ID NO: 34473 - protein, 9 aa, Artificial Sequence
  Description of Artificial Sequence: Synthetic peptide
  Seed: MRLLPLLAL (INS_HUMAN)
MGLLPLLAY

SEQ ID NO: 34474 - protein, 9 aa, Artificial Sequence
  Description of Artificial Sequence: Synthetic peptide
  Seed: GPDPAAAFV (INS_HUMAN)
GVDPAAAFF

SEQ ID NO: 34475 - protein, 9 aa, Artificial Sequence
  Description of Artificial Sequence: Synthetic peptide
  Seed: ALEGSLQKR (INS_HUMAN)
AAEGSLQKL

SEQ ID NO: 34476 - protein, 10 aa, Artificial Sequence
  Description of Artificial Sequence: Synthetic peptide
  Seed: LALWGPDPAA (INS_HUMAN)
LYLWGPDPAL

SEQ ID NO: 34477 - protein, 10 aa, Artificial Sequence
  Description of Artificial Sequence: Synthetic peptide
  Seed: LWGPDPAAAF (INS_HUMAN)
LYGPDPAAAY

SEQ ID NO: 34478 - protein, 9 aa, Artificial Sequence
  Description of Artificial Sequence: Synthetic peptide
  Seed: AEDLQVGQV (INS_HUMAN)
AIDLQVGQF

SEQ ID NO: 34479 - protein, 10 aa, Artificial Sequence
  Description of Artificial Sequence: Synthetic peptide
  Seed: MALWMRLLPL (INS_HUMAN)
MALWMRLLPA

SEQ ID NO: 34480 - protein, 10 aa, Artificial Sequence
  Description of Artificial Sequence: Synthetic peptide
  Seed: ALWGPDPAAA (INS_HUMAN)
ATWGPDPAAV

SEQ ID NO: 34481 - protein, 11 aa, Artificial Sequence
  Description of Artificial Sequence: Synthetic peptide
  Seed: GSHLVEALYLV (INS_HUMAN)
GFHLVEALYLV

SEQ ID NO: 34482 - protein, 10 aa, Artificial Sequence
  Description of Artificial Sequence: Synthetic peptide
  Seed: LPLLALLALW (INS_HUMAN)
LSLLALLALF

SEQ ID NO: 34483 - protein, 10 aa, Artificial Sequence
  Description of Artificial Sequence: Synthetic peptide
  Seed: ALWMRLLPLL (INS_HUMAN)
AIWMRLLPLF

SEQ ID NO: 34484 - protein, 9 aa, Artificial Sequence
  Description of Artificial Sequence: Synthetic peptide
  Seed: LALEGSLQK (INS_HUMAN)
LALEGSLQM

SEQ ID NO: 34485 - protein, 9 aa, Artificial Sequence
  Description of Artificial Sequence: Synthetic peptide
  Seed: SLYQLENYC (INS_HUMAN)
SMYQLENYI

SEQ ID NO: 34486 - protein, 10 aa, Artificial Sequence
  Description of Artificial Sequence: Synthetic peptide
  Seed: SHLVEALYLV (INS_HUMAN)
STLVEALYLA

SEQ ID NO: 34487 - protein, 9 aa, Artificial Sequence
  Description of Artificial Sequence: Synthetic peptide
  Seed: GPDPAAAFV (INS_HUMAN)
GMDPAAAFM

SEQ ID NO: 34488 - protein, 11 aa, Artificial Sequence
  Description of Artificial Sequence: Synthetic peptide
  Seed: RGFFYTPKTRR (INS_HUMAN)
RSFFYTPKTRR

SEQ ID NO: 34489 - protein, 10 aa, Artificial Sequence
  Description of Artificial Sequence: Synthetic peptide
  Seed: MALWMRLLPL (INS_HUMAN)
MYLWMRLLPV

SEQ ID NO: 34490 - protein, 11 aa, Artificial Sequence
  Description of Artificial Sequence: Synthetic peptide
  Seed: ALWGPDPAAAF (INS_HUMAN)
ATWGPDPAAAY

SEQ ID NO: 34491 - protein, 8 aa, Artificial Sequence
  Description of Artificial Sequence: Synthetic peptide
  Seed: LVEALYLV (INS_HUMAN)
LYEALYLV

SEQ ID NO: 34492 - protein, 11 aa, Artificial Sequence
  Description of Artificial Sequence: Synthetic peptide
  Seed: ALWGPDPAAAF (INS_HUMAN)
ARWGPDPAAAL

SEQ ID NO: 34493 - protein, 10 aa, Artificial Sequence
  Description of Artificial Sequence: Synthetic peptide
  Seed: CTSICSLYQL (INS_HUMAN)
CVSICSLYQV

SEQ ID NO: 34494 - protein, 10 aa, Artificial Sequence
  Description of Artificial Sequence: Synthetic peptide
  Seed: ALWGPDPAAA (INS_HUMAN)
AVWGPDPAAR

SEQ ID NO: 34495 - protein, 9 aa, Artificial Sequence
  Description of Artificial Sequence: Synthetic peptide
  Seed: ALWGPDPAA (INS_HUMAN)
AVWGPDPAR

SEQ ID NO: 34496 - protein, 10 aa, Artificial Sequence
  Description of Artificial Sequence: Synthetic peptide
  Seed: LALWGPDPAA (INS_HUMAN)
LWLWGPDPAV

SEQ ID NO: 34497 - protein, 10 aa, Artificial Sequence
  Description of Artificial Sequence: Synthetic peptide
  Seed: RLLPLLALLA (INS_HUMAN)
RMLPLLALLI

SEQ ID NO: 34498 - protein, 10 aa, Artificial Sequence
  Description of Artificial Sequence: Synthetic peptide
  Seed: MALWMRLLPL (INS_HUMAN)
MDLWMRLLPF

SEQ ID NO: 34499 - protein, 10 aa, Artificial Sequence
  Description of Artificial Sequence: Synthetic peptide
  Seed: REAEDLQVGQ (INS_HUMAN)
RQAEDLQVGW

SEQ ID NO: 34500 - protein, 11 aa, Artificial Sequence
  Description of Artificial Sequence: Synthetic peptide
  Seed: GSHLVEALYLV (INS_HUMAN)
GDHLVEALYLI

SEQ ID NO: 34501 - protein, 9 aa, Artificial Sequence
  Description of Artificial Sequence: Synthetic peptide
  Seed: GPDPAAAFV (INS_HUMAN)
GTDPAAAFF

SEQ ID NO: 34502 - protein, 10 aa, Artificial Sequence
  Description of Artificial Sequence: Synthetic peptide
  Seed: CTSICSLYQL (INS_HUMAN)
CMSICSLYQV

SEQ ID NO: 34503 - protein, 10 aa, Artificial Sequence
  Description of Artificial Sequence: Synthetic peptide
  Seed: ALWMRLLPLL (INS_HUMAN)
AFWMRLLPLW

SEQ ID NO: 34504 - protein, 9 aa, Artificial Sequence
  Description of Artificial Sequence: Synthetic peptide
  Seed: AEDLQVGQV (INS_HUMAN)
AEDLQVGQF

SEQ ID NO: 34505 - protein, 11 aa, Artificial Sequence
  Description of Artificial Sequence: Synthetic peptide
  Seed: ALWGPDPAAAF (INS_HUMAN)
AIWGPDPAAAF

SEQ ID NO: 34506 - protein, 10 aa, Artificial Sequence
  Description of Artificial Sequence: Synthetic peptide
  Seed: MALWMRLLPL (INS_HUMAN)
MQLWMRLLPF

SEQ ID NO: 34507 - protein, 10 aa, Artificial Sequence
  Description of Artificial Sequence: Synthetic peptide
  Seed: VNQHLCGSHL (INS_HUMAN)
VGQHLCGSHF

SEQ ID NO: 34508 - protein, 9 aa, Artificial Sequence
  Description of Artificial Sequence: Synthetic peptide
  Seed: GPDPAAAFV (INS_HUMAN)
GADPAAAFI

SEQ ID NO: 34509 - protein, 11 aa, Artificial Sequence
  Description of Artificial Sequence: Synthetic peptide
  Seed: WMRLLPLLALL (INS_HUMAN)
WERLLPLLALV

SEQ ID NO: 34510 - protein, 9 aa, Artificial Sequence
  Description of Artificial Sequence: Synthetic peptide
  Seed: GPDPAAAFV (INS_HUMAN)
GLDPAAAFI

SEQ ID NO: 34511 - protein, 9 aa, Artificial Sequence
  Description of Artificial Sequence: Synthetic peptide
  Seed: HLVEALYLV (INS_HUMAN)
HVVEALYLV

SEQ ID NO: 34512 - protein, 9 aa, Artificial Sequence
  Description of Artificial Sequence: Synthetic peptide
  Seed: HLVEALYLV (INS_HUMAN)
HTVEALYLR

SEQ ID NO: 34513 - protein, 11 aa, Artificial Sequence
  Description of Artificial Sequence: Synthetic peptide
  Seed: RLLPLLALLAL (INS_HUMAN)
RTLPLLALLAV

SEQ ID NO: 34514 - protein, 10 aa, Artificial Sequence
  Description of Artificial Sequence: Synthetic peptide
  Seed: WMRLLPLLAL (INS_HUMAN)
WWRLLPLLAK

SEQ ID NO: 34515 - protein, 10 aa, Artificial Sequence
  Description of Artificial Sequence: Synthetic peptide
  Seed: HLVEALYLVC (INS_HUMAN)
HMVEALYLVI

SEQ ID NO: 34516 - protein, 9 aa, Artificial Sequence
  Description of Artificial Sequence: Synthetic peptide
  Seed: NQHLCGSHL (INS_HUMAN)
NVHLCGSHY

SEQ ID NO: 34517 - protein, 10 aa, Artificial Sequence
  Description of Artificial Sequence: Synthetic peptide
  Seed: LLPLLALLAL (INS_HUMAN)
LQPLLALLAL

SEQ ID NO: 34518 - protein, 9 aa, Artificial Sequence
  Description of Artificial Sequence: Synthetic peptide
  Seed: MRLLPLLAL (INS_HUMAN)
MTLLPLLAF

SEQ ID NO: 34519 - protein, 10 aa, Artificial Sequence
  Description of Artificial Sequence: Synthetic peptide
  Seed: FVNQHLCGSH (INS_HUMAN)
FANQHLCGSY

SEQ ID NO: 34520 - protein, 9 aa, Artificial Sequence
  Description of Artificial Sequence: Synthetic peptide
  Seed: ALWMRLLPL (INS_HUMAN)
ASWMRLLPM

SEQ ID NO: 34521 - protein, 9 aa, Artificial Sequence
  Description of Artificial Sequence: Synthetic peptide
  Seed: FFYTPKTRR (INS_HUMAN)
FMYTPKTRR

SEQ ID NO: 34522 - protein, 10 aa, Artificial Sequence
  Description of Artificial Sequence: Synthetic peptide
  Seed: RLLPLLALLA (INS_HUMAN)
RMLPLLALLL

SEQ ID NO: 34523 - protein, 9 aa, Artificial Sequence
  Description of Artificial Sequence: Synthetic peptide
  Seed: FFYTPKTRR (INS_HUMAN)
FNYTPKTRR

SEQ ID NO: 34524 - protein, 11 aa, Artificial Sequence
  Description of Artificial Sequence: Synthetic peptide
  Seed: WMRLLPLLALL (INS_HUMAN)
WVRLLPLLALL

SEQ ID NO: 34525 - protein, 9 aa, Artificial Sequence
  Description of Artificial Sequence: Synthetic peptide
  Seed: HLVEALYLV (INS_HUMAN)
HQVEALYLA

SEQ ID NO: 34526 - protein, 11 aa, Artificial Sequence
  Description of Artificial Sequence: Synthetic peptide
  Seed: ALWGPDPAAAF (INS_HUMAN)
AYWGPDPAAAF

SEQ ID NO: 34527 - protein, 10 aa, Artificial Sequence
  Description of Artificial Sequence: Synthetic peptide
  Seed: RLLPLLALLA (INS_HUMAN)
RMLPLLALLV

SEQ ID NO: 34528 - protein, 10 aa, Artificial Sequence
  Description of Artificial Sequence: Synthetic peptide
  Seed: ALWMRLLPLL (INS_HUMAN)
AHWMRLLPLW

SEQ ID NO: 34529 - protein, 10 aa, Artificial Sequence
  Description of Artificial Sequence: Synthetic peptide
  Seed: ALWMRLLPLL (INS_HUMAN)
AAWMRLLPLV

SEQ ID NO: 34530 - protein, 9 aa, Artificial Sequence
  Description of Artificial Sequence: Synthetic peptide
  Seed: LPLLALLAL (INS_HUMAN)
LQLLALLAF

SEQ ID NO: 34531 - protein, 11 aa, Artificial Sequence
  Description of Artificial Sequence: Synthetic peptide
  Seed: REAEDLQVGQV (INS_HUMAN)
REAEDLQVGQA

SEQ ID NO: 34532 - protein, 10 aa, Artificial Sequence
  Description of Artificial Sequence: Synthetic peptide
  Seed: GIVEQCCTSI (INS_HUMAN)
GLVEQCCTSI

SEQ ID NO: 34533 - protein, 11 aa, Artificial Sequence
  Description of Artificial Sequence: Synthetic peptide
  Seed: GSHLVEALYLV (INS_HUMAN)
GTHLVEALYLL

SEQ ID NO: 34534 - protein, 10 aa, Artificial Sequence
  Description of Artificial Sequence: Synthetic peptide
  Seed: RGFFYTPKTR (INS_HUMAN)
RYFFYTPKTK

SEQ ID NO: 34535 - protein, 10 aa, Artificial Sequence
  Description of Artificial Sequence: Synthetic peptide
  Seed: LLALWGPDPA (INS_HUMAN)
LMALWGPDPI

SEQ ID NO: 34536 - protein, 9 aa, Artificial Sequence
  Description of Artificial Sequence: Synthetic peptide
  Seed: NQHLCGSHL (INS_HUMAN)
NLHLCGSHY

SEQ ID NO: 34537 - protein, 9 aa, Artificial Sequence
  Description of Artificial Sequence: Synthetic peptide
  Seed: AEDLQVGQV (INS_HUMAN)
AIDLQVGQL

SEQ ID NO: 34538 - protein, 9 aa, Artificial Sequence
  Description of Artificial Sequence: Synthetic peptide
  Seed: RLLPLLALL (INS_HUMAN)
RALPLLALL

SEQ ID NO: 34539 - protein, 10 aa, Artificial Sequence
  Description of Artificial Sequence: Synthetic peptide
  Seed: MRLLPLLALL (INS_HUMAN)
MWLLPLLALV

SEQ ID NO: 34540 - protein, 11 aa, Artificial Sequence
  Description of Artificial Sequence: Synthetic peptide
  Seed: WMRLLPLLALL (INS_HUMAN)
WVRLLPLLALV

SEQ ID NO: 34541 - protein, 9 aa, Artificial Sequence
  Description of Artificial Sequence: Synthetic peptide
  Seed: LALEGSLQK (INS_HUMAN)
LALEGSLQR

SEQ ID NO: 34542 - protein, 9 aa, Artificial Sequence
  Description of Artificial Sequence: Synthetic peptide
  Seed: LWMRLLPLL (INS_HUMAN)
LYMRLLPLV

SEQ ID NO: 34543 - protein, 9 aa, Artificial Sequence
  Description of Artificial Sequence: Synthetic peptide
  Seed: AGSLQPLAL (INS_HUMAN)
AVSLQPLAY

SEQ ID NO: 34544 - protein, 11 aa, Artificial Sequence
  Description of Artificial Sequence: Synthetic peptide
  Seed: SHLVEALYLVC (INS_HUMAN)
SLLVEALYLVD

SEQ ID NO: 34545 - protein, 11 aa, Artificial Sequence
  Description of Artificial Sequence: Synthetic peptide
  Seed: GSHLVEALYLV (INS_HUMAN)
GHHLVEALYLI

SEQ ID NO: 34546 - protein, 10 aa, Artificial Sequence
  Description of Artificial Sequence: Synthetic peptide
  Seed: VELGGGPGAG (INS_HUMAN)
VELGGGPGAI

SEQ ID NO: 34547 - protein, 9 aa, Artificial Sequence
  Description of Artificial Sequence: Synthetic peptide
  Seed: FFYTPKTRR (INS_HUMAN)
FMYTPKTRK

SEQ ID NO: 34548 - protein, 9 aa, Artificial Sequence
  Description of Artificial Sequence: Synthetic peptide
  Seed: HLVEALYLV (INS_HUMAN)
HLVEALYLF

SEQ ID NO: 34549 - protein, 11 aa, Artificial Sequence
  Description of Artificial Sequence: Synthetic peptide
  Seed: HLVEALYLVCG (INS_HUMAN)
HLVEALYLVCI

SEQ ID NO: 34550 - protein, 10 aa, Artificial Sequence
  Description of Artificial Sequence: Synthetic peptide
  Seed: MRLLPLLALL (INS_HUMAN)
MDLLPLLALM

SEQ ID NO: 34551 - protein, 9 aa, Artificial Sequence
  Description of Artificial Sequence: Synthetic peptide
  Seed: YLVCGERGF (INS_HUMAN)
YQVCGERGY

SEQ ID NO: 34552 - protein, 11 aa, Artificial Sequence
  Description of Artificial Sequence: Synthetic peptide
  Seed: GSHLVEALYLV (INS_HUMAN)
GMHLVEALYLI

SEQ ID NO: 34553 - protein, 9 aa, Artificial Sequence
  Description of Artificial Sequence: Synthetic peptide
  Seed: AGSLQPLAL (INS_HUMAN)
APSLQPLAV

SEQ ID NO: 34554 - protein, 9 aa, Artificial Sequence
  Description of Artificial Sequence: Synthetic peptide
  Seed: GPDPAAAFV (INS_HUMAN)
GWDPAAAFM

SEQ ID NO: 34555 - protein, 11 aa, Artificial Sequence
  Description of Artificial Sequence: Synthetic peptide
  Seed: SHLVEALYLVC (INS_HUMAN)
SMLVEALYLVI

SEQ ID NO: 34556 - protein, 11 aa, Artificial Sequence
  Description of Artificial Sequence: Synthetic peptide
  Seed: SHLVEALYLVC (INS_HUMAN)
SLLVEALYLVK

SEQ ID NO: 34557 - protein, 8 aa, Artificial Sequence
  Description of Artificial Sequence: Synthetic peptide
  Seed: GPDPAAAF (INS_HUMAN)
GVDPAAAL

SEQ ID NO: 34558 - protein, 10 aa, Artificial Sequence
  Description of Artificial Sequence: Synthetic peptide
  Seed: MALWMRLLPL (INS_HUMAN)
MYLWMRLLPA

SEQ ID NO: 34559 - protein, 9 aa, Artificial Sequence
  Description of Artificial Sequence: Synthetic peptide
  Seed: AEDLQVGQV (INS_HUMAN)
ATDLQVGQM

SEQ ID NO: 34560 - protein, 10 aa, Artificial Sequence
  Description of Artificial Sequence: Synthetic peptide
  Seed: VNQHLCGSHL (INS_HUMAN)
VHQHLCGSHY

SEQ ID NO: 34561 - protein, 10 aa, Artificial Sequence
  Description of Artificial Sequence: Synthetic peptide
  Seed: LPLLALLALW (INS_HUMAN)
LSLLALLALW

SEQ ID NO: 34562 - protein, 9 aa, Artificial Sequence
  Description of Artificial Sequence: Synthetic peptide
  Seed: NQHLCGSHL (INS_HUMAN)
NLHLCGSHF

SEQ ID NO: 34563 - protein, 9 aa, Artificial Sequence
  Description of Artificial Sequence: Synthetic peptide
  Seed: GPDPAAAFV (INS_HUMAN)
GGDPAAAFF

SEQ ID NO: 34564 - protein, 10 aa, Artificial Sequence
  Description of Artificial Sequence: Synthetic peptide
  Seed: SHLVEALYLV (INS_HUMAN)
SELVEALYLA

SEQ ID NO: 34565 - protein, 8 aa, Artificial Sequence
  Description of Artificial Sequence: Synthetic peptide
  Seed: LWMRLLPL (INS_HUMAN)
LIMRLLPL

SEQ ID NO: 34566 - protein, 10 aa, Artificial Sequence
  Description of Artificial Sequence: Synthetic peptide
  Seed: LALEGSLQKR (INS_HUMAN)
LMLEGSLQKR

SEQ ID NO: 34567 - protein, 9 aa, Artificial Sequence
  Description of Artificial Sequence: Synthetic peptide
  Seed: ALWMRLLPL (INS_HUMAN)
AQWMRLLPT

SEQ ID NO: 34568 - protein, 8 aa, Artificial Sequence
  Description of Artificial Sequence: Synthetic peptide
  Seed: RGFFYTPK (INS_HUMAN)
RGFFYTPR

SEQ ID NO: 34569 - protein, 9 aa, Artificial Sequence
  Description of Artificial Sequence: Synthetic peptide
  Seed: CCTSICSLY (INS_HUMAN)
CFTSICSLY

SEQ ID NO: 34570 - protein, 11 aa, Artificial Sequence
  Description of Artificial Sequence: Synthetic peptide
  Seed: GQVELGGGPGA (INS_HUMAN)
GEVELGGGPGA

SEQ ID NO: 34571 - protein, 10 aa, Artificial Sequence
  Description of Artificial Sequence: Synthetic peptide
  Seed: SHLVEALYLV (INS_HUMAN)
SHLVEALYLM

SEQ ID NO: 34572 - protein, 9 aa, Artificial Sequence
  Description of Artificial Sequence: Synthetic peptide
  Seed: CSLYQLENY (INS_HUMAN)
CQLYQLENY

SEQ ID NO: 34573 - protein, 9 aa, Artificial Sequence
  Description of Artificial Sequence: Synthetic peptide
  Seed: LALEGSLQK (INS_HUMAN)
LSLEGSLQR

SEQ ID NO: 34574 - protein, 11 aa, Artificial Sequence
  Description of Artificial Sequence: Synthetic peptide
  Seed: MALWMRLLPLL (INS_HUMAN)
MTLWMRLLPLF

SEQ ID NO: 34575 - protein, 11 aa, Artificial Sequence
  Description of Artificial Sequence: Synthetic peptide
  Seed: MALWMRLLPLL (INS_HUMAN)
MYLWMRLLPLL

SEQ ID NO: 34576 - protein, 9 aa, Artificial Sequence
  Description of Artificial Sequence: Synthetic peptide
  Seed: ALEGSLQKR (INS_HUMAN)
ALEGSLQKY

SEQ ID NO: 34577 - protein, 9 aa, Artificial Sequence
  Description of Artificial Sequence: Synthetic peptide
  Seed: ALEGSLQKR (INS_HUMAN)
ATEGSLQKY

SEQ ID NO: 34578 - protein, 10 aa, Artificial Sequence
  Description of Artificial Sequence: Synthetic peptide
  Seed: EDLQVGQVEL (INS_HUMAN)
EELQVGQVEL

SEQ ID NO: 34579 - protein, 10 aa, Artificial Sequence
  Description of Artificial Sequence: Synthetic peptide
  Seed: MRLLPLLALL (INS_HUMAN)
MTLLPLLALL

SEQ ID NO: 34580 - protein, 10 aa, Artificial Sequence
  Description of Artificial Sequence: Synthetic peptide
  Seed: RGFFYTPKTR (INS_HUMAN)
RHFFYTPKTR

SEQ ID NO: 34581 - protein, 10 aa, Artificial Sequence
  Description of Artificial Sequence: Synthetic peptide
  Seed: ALWMRLLPLL (INS_HUMAN)
AYWMRLLPLW

SEQ ID NO: 34582 - protein, 10 aa, Artificial Sequence
  Description of Artificial Sequence: Synthetic peptide
  Seed: MRLLPLLALL (INS_HUMAN)
MTLLPLLALV

SEQ ID NO: 34583 - protein, 9 aa, Artificial Sequence
  Description of Artificial Sequence: Synthetic peptide
  Seed: WGPDPAAAF (INS_HUMAN)
WLPDPAAAL

SEQ ID NO: 34584 - protein, 9 aa, Artificial Sequence
  Description of Artificial Sequence: Synthetic peptide
  Seed: HLVEALYLV (INS_HUMAN)
HMVEALYLF

SEQ ID NO: 34585 - protein, 9 aa, Artificial Sequence
  Description of Artificial Sequence: Synthetic peptide
  Seed: YLVCGERGF (INS_HUMAN)
YMVCGERGF

SEQ ID NO: 34586 - protein, 10 aa, Artificial Sequence
  Description of Artificial Sequence: Synthetic peptide
  Seed: EALYLVCGER (INS_HUMAN)
ESLYLVCGER

SEQ ID NO: 34587 - protein, 10 aa, Artificial Sequence
  Description of Artificial Sequence: Synthetic peptide
  Seed: SHLVEALYLV (INS_HUMAN)
SSLVEALYLL

SEQ ID NO: 34588 - protein, 10 aa, Artificial Sequence
  Description of Artificial Sequence: Synthetic peptide
  Seed: MRLLPLLALL (INS_HUMAN)
MMLLPLLALL

SEQ ID NO: 34589 - protein, 10 aa, Artificial Sequence
  Description of Artificial Sequence: Synthetic peptide
  Seed: WMRLLPLLAL (INS_HUMAN)
WMRLLPLLAY

SEQ ID NO: 34590 - protein, 9 aa, Artificial Sequence
  Description of Artificial Sequence: Synthetic peptide
  Seed: ALWGPDPAA (INS_HUMAN)
AIWGPDPAI

SEQ ID NO: 34591 - protein, 11 aa, Artificial Sequence
  Description of Artificial Sequence: Synthetic peptide
  Seed: ALWGPDPAAAF (INS_HUMAN)
AQWGPDPAAAM

SEQ ID NO: 34592 - protein, 9 aa, Artificial Sequence
  Description of Artificial Sequence: Synthetic peptide
  Seed: RLLPLLALL (INS_HUMAN)
RFLPLLALK

SEQ ID NO: 34593 - protein, 9 aa, Artificial Sequence
  Description of Artificial Sequence: Synthetic peptide
  Seed: LALEGSLQK (INS_HUMAN)
LVLEGSLQL

SEQ ID NO: 34594 - protein, 9 aa, Artificial Sequence
  Description of Artificial Sequence: Synthetic peptide
  Seed: RLLPLLALL (INS_HUMAN)
RGLPLLALR

SEQ ID NO: 34595 - protein, 11 aa, Artificial Sequence
  Description of Artificial Sequence: Synthetic peptide
  Seed: WMRLLPLLALL (INS_HUMAN)
WFRLLPLLALV

SEQ ID NO: 34596 - protein, 10 aa, Artificial Sequence
  Description of Artificial Sequence: Synthetic peptide
  Seed: LVCGERGFFY (INS_HUMAN)
LFCGERGFFY

SEQ ID NO: 34597 - protein, 9 aa, Artificial Sequence
  Description of Artificial Sequence: Synthetic peptide
  Seed: ALWMRLLPL (INS_HUMAN)
AKWMRLLPL

SEQ ID NO: 34598 - protein, 9 aa, Artificial Sequence
  Description of Artificial Sequence: Synthetic peptide
  Seed: HLVEALYLV (INS_HUMAN)
HAVEALYLI

SEQ ID NO: 34599 - protein, 9 aa, Artificial Sequence
  Description of Artificial Sequence: Synthetic peptide
  Seed: AAAFVNQHL (INS_HUMAN)
AIAFVNQHL

SEQ ID NO: 34600 - protein, 10 aa, Artificial Sequence
  Description of Artificial Sequence: Synthetic peptide
  Seed: HLVEALYLVC (INS_HUMAN)
HMVEALYLVR

SEQ ID NO: 34601 - protein, 10 aa, Artificial Sequence
  Description of Artificial Sequence: Synthetic peptide
  Seed: VNQHLCGSHL (INS_HUMAN)
VKQHLCGSHY

SEQ ID NO: 34602 - protein, 10 aa, Artificial Sequence
  Description of Artificial Sequence: Synthetic peptide
  Seed: MRLLPLLALL (INS_HUMAN)
MCLLPLLALV

SEQ ID NO: 34603 - protein, 9 aa, Artificial Sequence
  Description of Artificial Sequence: Synthetic peptide
  Seed: AEDLQVGQV (INS_HUMAN)
ANDLQVGQL

SEQ ID NO: 34604 - protein, 10 aa, Artificial Sequence
  Description of Artificial Sequence: Synthetic peptide
  Seed: ALWMRLLPLL (INS_HUMAN)
ACWMRLLPLF

SEQ ID NO: 34605 - protein, 10 aa, Artificial Sequence
  Description of Artificial Sequence: Synthetic peptide
  Seed: MALWMRLLPL (INS_HUMAN)
MMLWMRLLPI

SEQ ID NO: 34606 - protein, 10 aa, Artificial Sequence
  Description of Artificial Sequence: Synthetic peptide
  Seed: SHLVEALYLV (INS_HUMAN)
SILVEALYLV

SEQ ID NO: 34607 - protein, 9 aa, Artificial Sequence
  Description of Artificial Sequence: Synthetic peptide
  Seed: VEQCCTSIC (INS_HUMAN)
VEQCCTSIA

SEQ ID NO: 34608 - protein, 10 aa, Artificial Sequence
  Description of Artificial Sequence: Synthetic peptide
  Seed: ALWMRLLPLL (INS_HUMAN)
AQWMRLLPLA

SEQ ID NO: 34609 - protein, 9 aa, Artificial Sequence
  Description of Artificial Sequence: Synthetic peptide
  Seed: LALWGPDPA (INS_HUMAN)
LILWGPDPL

SEQ ID NO: 34610 - protein, 9 aa, Artificial Sequence
  Description of Artificial Sequence: Synthetic peptide
  Seed: AAAFVNQHL (INS_HUMAN)
ATAFVNQHM

SEQ ID NO: 34611 - protein, 11 aa, Artificial Sequence
  Description of Artificial Sequence: Synthetic peptide
  Seed: GSHLVEALYLV (INS_HUMAN)
GPHLVEALYLV

SEQ ID NO: 34612 - protein, 9 aa, Artificial Sequence
  Description of Artificial Sequence: Synthetic peptide
  Seed: AAAFVNQHL (INS_HUMAN)
ARAFVNQHF

SEQ ID NO: 34613 - protein, 10 aa, Artificial Sequence
  Description of Artificial Sequence: Synthetic peptide
  Seed: VNQHLCGSHL (INS_HUMAN)
VCQHLCGSHY

SEQ ID NO: 34614 - protein, 10 aa, Artificial Sequence
  Description of Artificial Sequence: Synthetic peptide
  Seed: ALWMRLLPLL (INS_HUMAN)
AQWMRLLPLV

SEQ ID NO: 34615 - protein, 10 aa, Artificial Sequence
  Description of Artificial Sequence: Synthetic peptide
  Seed: LALEGSLQKR (INS_HUMAN)
LVLEGSLQKK

SEQ ID NO: 34616 - protein, 10 aa, Artificial Sequence
  Description of Artificial Sequence: Synthetic peptide
  Seed: SHLVEALYLV (INS_HUMAN)
SWLVEALYLV

SEQ ID NO: 34617 - protein, 9 aa, Artificial Sequence
  Description of Artificial Sequence: Synthetic peptide
  Seed: GPDPAAAFV (INS_HUMAN)
GIDPAAAFL

SEQ ID NO: 34618 - protein, 9 aa, Artificial Sequence
  Description of Artificial Sequence: Synthetic peptide
  Seed: ALWMRLLPL (INS_HUMAN)
AEWMRLLPM

SEQ ID NO: 34619 - protein, 11 aa, Artificial Sequence
  Description of Artificial Sequence: Synthetic peptide
  Seed: RGFFYTPKTRR (INS_HUMAN)
RRFFYTPKTRR

SEQ ID NO: 34620 - protein, 9 aa, Artificial Sequence
  Description of Artificial Sequence: Synthetic peptide
  Seed: FFYTPKTRR (INS_HUMAN)
FWYTPKTRR

SEQ ID NO: 34621 - protein, 11 aa, Artificial Sequence
  Description of Artificial Sequence: Synthetic peptide
  Seed: RLLPLLALLAL (INS_HUMAN)
RVLPLLALLAV

SEQ ID NO: 34622 - protein, 11 aa, Artificial Sequence
  Description of Artificial Sequence: Synthetic peptide
  Seed: LWMRLLPLLAL (INS_HUMAN)
LRMRLLPLLAL

SEQ ID NO: 34623 - protein, 9 aa, Artificial Sequence
  Description of Artificial Sequence: Synthetic peptide
  Seed: RLLPLLALL (INS_HUMAN)
RVLPLLALV

SEQ ID NO: 34624 - protein, 10 aa, Artificial Sequence
  Description of Artificial Sequence: Synthetic peptide
  Seed: ALWMRLLPLL (INS_HUMAN)
ANWMRLLPLF

SEQ ID NO: 34625 - protein, 10 aa, Artificial Sequence
  Description of Artificial Sequence: Synthetic peptide
  Seed: FVNQHLCGSH (INS_HUMAN)
FANQHLCGSF

SEQ ID NO: 34626 - protein, 9 aa, Artificial Sequence
  Description of Artificial Sequence: Synthetic peptide
  Seed: LALWGPDPA (INS_HUMAN)
LMLWGPDPM

SEQ ID NO: 34627 - protein, 10 aa, Artificial Sequence
  Description of Artificial Sequence: Synthetic peptide
  Seed: HLVEALYLVC (INS_HUMAN)
HMVEALYLVW

SEQ ID NO: 34628 - protein, 9 aa, Artificial Sequence
  Description of Artificial Sequence: Synthetic peptide
  Seed: AAFVNQHLC (INS_HUMAN)
ATFVNQHLY

SEQ ID NO: 34629 - protein, 9 aa, Artificial Sequence
  Description of Artificial Sequence: Synthetic peptide
  Seed: ALWMRLLPL (INS_HUMAN)
AIWMRLLPY

SEQ ID NO: 34630 - protein, 9 aa, Artificial Sequence
  Description of Artificial Sequence: Synthetic peptide
  Seed: ALWMRLLPL (INS_HUMAN)
ALWMRLLPI

SEQ ID NO: 34631 - protein, 9 aa, Artificial Sequence
  Description of Artificial Sequence: Synthetic peptide
  Seed: GPDPAAAFV (INS_HUMAN)
GLDPAAAFM

SEQ ID NO: 34632 - protein, 8 aa, Artificial Sequence
  Description of Artificial Sequence: Synthetic peptide
  Seed: GPDPAAAF (INS_HUMAN)
GTDPAAAV

SEQ ID NO: 34633 - protein, 10 aa, Artificial Sequence
  Description of Artificial Sequence: Synthetic peptide
  Seed: MALWMRLLPL (INS_HUMAN)
MDLWMRLLPI

SEQ ID NO: 34634 - protein, 9 aa, Artificial Sequence
  Description of Artificial Sequence: Synthetic peptide
  Seed: LALEGSLQK (INS_HUMAN)
LILEGSLQK

SEQ ID NO: 34635 - protein, 9 aa, Artificial Sequence
  Description of Artificial Sequence: Synthetic peptide
  Seed: RLLPLLALL (INS_HUMAN)
RNLPLLALK

SEQ ID NO: 34636 - protein, 11 aa, Artificial Sequence
  Description of Artificial Sequence: Synthetic peptide
  Seed: SHLVEALYLVC (INS_HUMAN)
SFLVEALYLVI

SEQ ID NO: 34637 - protein, 9 aa, Artificial Sequence
  Description of Artificial Sequence: Synthetic peptide
  Seed: ALWMRLLPL (INS_HUMAN)
AIWMRLLPW

SEQ ID NO: 34638 - protein, 9 aa, Artificial Sequence
  Description of Artificial Sequence: Synthetic peptide
  Seed: ALWGPDPAA (INS_HUMAN)
AQWGPDPAI

SEQ ID NO: 34639 - protein, 10 aa, Artificial Sequence
  Description of Artificial Sequence: Synthetic peptide
  Seed: MRLLPLLALL (INS_HUMAN)
MLLLPLLALI

SEQ ID NO: 34640 - protein, 11 aa, Artificial Sequence
  Description of Artificial Sequence: Synthetic peptide
  Seed: REAEDLQVGQV (INS_HUMAN)
REAEDLQVGQI

SEQ ID NO: 34641 - protein, 9 aa, Artificial Sequence
  Description of Artificial Sequence: Synthetic peptide
  Seed: AGSLQPLAL (INS_HUMAN)
APSLQPLAI

SEQ ID NO: 34642 - protein, 9 aa, Artificial Sequence
  Description of Artificial Sequence: Synthetic peptide
  Seed: LALEGSLQK (INS_HUMAN)
LLLEGSLQK

SEQ ID NO: 34643 - protein, 9 aa, Artificial Sequence
  Description of Artificial Sequence: Synthetic peptide
  Seed: YTPKTRREA (INS_HUMAN)
YCPKTRREL

SEQ ID NO: 34644 - protein, 10 aa, Artificial Sequence
  Description of Artificial Sequence: Synthetic peptide
  Seed: MRLLPLLALL (INS_HUMAN)
MGLLPLLALL

SEQ ID NO: 34645 - protein, 10 aa, Artificial Sequence
  Description of Artificial Sequence: Synthetic peptide
  Seed: SHLVEALYLV (INS_HUMAN)
SHLVEALYLA

SEQ ID NO: 34646 - protein, 9 aa, Artificial Sequence
  Description of Artificial Sequence: Synthetic peptide
  Seed: FFYTPKTRR (INS_HUMAN)
FLYTPKTRR

SEQ ID NO: 34647 - protein, 9 aa, Artificial Sequence
  Description of Artificial Sequence: Synthetic peptide
  Seed: TSICSLYQL (INS_HUMAN)
TTICSLYQL

SEQ ID NO: 34648 - protein, 10 aa, Artificial Sequence
  Description of Artificial Sequence: Synthetic peptide
  Seed: MALWMRLLPL (INS_HUMAN)
MALWMRLLPM

SEQ ID NO: 34649 - protein, 9 aa, Artificial Sequence
  Description of Artificial Sequence: Synthetic peptide
  Seed: ALWGPDPAA (INS_HUMAN)
AMWGPDPAL

SEQ ID NO: 34650 - protein, 9 aa, Artificial Sequence
  Description of Artificial Sequence: Synthetic peptide
  Seed: AGSLQPLAL (INS_HUMAN)
AMSLQPLAM

SEQ ID NO: 34651 - protein, 10 aa, Artificial Sequence
  Description of Artificial Sequence: Synthetic peptide
  Seed: ALWGPDPAAA (INS_HUMAN)
AMWGPDPAAA

SEQ ID NO: 34652 - protein, 9 aa, Artificial Sequence
  Description of Artificial Sequence: Synthetic peptide
  Seed: NQHLCGSHL (INS_HUMAN)
NQHLCGSHF

SEQ ID NO: 34653 - protein, 11 aa, Artificial Sequence
  Description of Artificial Sequence: Synthetic peptide
  Seed: MALWMRLLPLL (INS_HUMAN)
MFLWMRLLPLF

SEQ ID NO: 34654 - protein, 11 aa, Artificial Sequence
  Description of Artificial Sequence: Synthetic peptide
  Seed: REAEDLQVGQV (INS_HUMAN)
RQAEDLQVGQF

SEQ ID NO: 34655 - protein, 9 aa, Artificial Sequence
  Description of Artificial Sequence: Synthetic peptide
  Seed: GPDPAAAFV (INS_HUMAN)
GADPAAAFM

SEQ ID NO: 34656 - protein, 8 aa, Artificial Sequence
  Description of Artificial Sequence: Synthetic peptide
  Seed: RLLPLLAL (INS_HUMAN)
RQLPLLAI

SEQ ID NO: 34657 - protein, 10 aa, Artificial Sequence
  Description of Artificial Sequence: Synthetic peptide
  Seed: VELGGGPGAG (INS_HUMAN)
VELGGGPGAA

SEQ ID NO: 34658 - protein, 10 aa, Artificial Sequence
  Description of Artificial Sequence: Synthetic peptide
  Seed: MRLLPLLALL (INS_HUMAN)
MRLLPLLALA

SEQ ID NO: 34659 - protein, 10 aa, Artificial Sequence
  Description of Artificial Sequence: Synthetic peptide
  Seed: VNQHLCGSHL (INS_HUMAN)
VLQHLCGSHY

SEQ ID NO: 34660 - protein, 9 aa, Artificial Sequence
  Description of Artificial Sequence: Synthetic peptide
  Seed: RLLPLLALL (INS_HUMAN)
RWLPLLALW

SEQ ID NO: 34661 - protein, 9 aa, Artificial Sequence
  Description of Artificial Sequence: Synthetic peptide
  Seed: AAAFVNQHL (INS_HUMAN)
AMAFVNQHF

SEQ ID NO: 34662 - protein, 9 aa, Artificial Sequence
  Description of Artificial Sequence: Synthetic peptide
  Seed: KTRREAEDL (INS_HUMAN)
KTRREAEDK

SEQ ID NO: 34663 - protein, 11 aa, Artificial Sequence
  Description of Artificial Sequence: Synthetic peptide
  Seed: WMRLLPLLALL (INS_HUMAN)
WRRLLPLLALL

SEQ ID NO: 34664 - protein, 9 aa, Artificial Sequence
  Description of Artificial Sequence: Synthetic peptide
  Seed: TSICSLYQL (INS_HUMAN)
TMICSLYQC

SEQ ID NO: 34665 - protein, 9 aa, Artificial Sequence
  Description of Artificial Sequence: Synthetic peptide
  Seed: AAAFVNQHL (INS_HUMAN)
ALAFVNQHM

SEQ ID NO: 34666 - protein, 10 aa, Artificial Sequence
  Description of Artificial Sequence: Synthetic peptide
  Seed: WMRLLPLLAL (INS_HUMAN)
WKRLLPLLAY

SEQ ID NO: 34667 - protein, 9 aa, Artificial Sequence
  Description of Artificial Sequence: Synthetic peptide
  Seed: RLLPLLALL (INS_HUMAN)
RYLPLLALY

SEQ ID NO: 34668 - protein, 10 aa, Artificial Sequence
  Description of Artificial Sequence: Synthetic peptide
  Seed: WGPDPAAAFV (INS_HUMAN)
WVPDPAAAFL

SEQ ID NO: 34669 - protein, 9 aa, Artificial Sequence
  Description of Artificial Sequence: Synthetic peptide
  Seed: AAAFVNQHL (INS_HUMAN)
AQAFVNQHY

SEQ ID NO: 34670 - protein, 10 aa, Artificial Sequence
  Description of Artificial Sequence: Synthetic peptide
  Seed: ALWMRLLPLL (INS_HUMAN)
AMWMRLLPLV

SEQ ID NO: 34671 - protein, 9 aa, Artificial Sequence
  Description of Artificial Sequence: Synthetic peptide
  Seed: HLVEALYLV (INS_HUMAN)
HIVEALYLV

SEQ ID NO: 34672 - protein, 9 aa, Artificial Sequence
  Description of Artificial Sequence: Synthetic peptide
  Seed: GPDPAAAFV (INS_HUMAN)
GIDPAAAFM

SEQ ID NO: 34673 - protein, 10 aa, Artificial Sequence
  Description of Artificial Sequence: Synthetic peptide
  Seed: WMRLLPLLAL (INS_HUMAN)
WLRLLPLLAL

SEQ ID NO: 34674 - protein, 9 aa, Artificial Sequence
  Description of Artificial Sequence: Synthetic peptide
  Seed: YLVCGERGF (INS_HUMAN)
YQVCGERGM

SEQ ID NO: 34675 - protein, 10 aa, Artificial Sequence
  Description of Artificial Sequence: Synthetic peptide
  Seed: LALWGPDPAA (INS_HUMAN)
LGLWGPDPAV

SEQ ID NO: 34676 - protein, 9 aa, Artificial Sequence
  Description of Artificial Sequence: Synthetic peptide
  Seed: HLVEALYLV (INS_HUMAN)
HLVEALYLK

SEQ ID NO: 34677 - protein, 11 aa, Artificial Sequence
  Description of Artificial Sequence: Synthetic peptide
  Seed: MALWMRLLPLL (INS_HUMAN)
MSLWMRLLPLF

SEQ ID NO: 34678 - protein, 10 aa, Artificial Sequence
  Description of Artificial Sequence: Synthetic peptide
  Seed: RGFFYTPKTR (INS_HUMAN)
RLFFYTPKTR

SEQ ID NO: 34679 - protein, 11 aa, Artificial Sequence
  Description of Artificial Sequence: Synthetic peptide
  Seed: ALWGPDPAAAF (INS_HUMAN)
AIWGPDPAAAY

SEQ ID NO: 34680 - protein, 9 aa, Artificial Sequence
  Description of Artificial Sequence: Synthetic peptide
  Seed: AAAFVNQHL (INS_HUMAN)
ASAFVNQHY

SEQ ID NO: 34681 - protein, 10 aa, Artificial Sequence
  Description of Artificial Sequence: Synthetic peptide
  Seed: EALYLVCGER (INS_HUMAN)
EVLYLVCGER

SEQ ID NO: 34682 - protein, 10 aa, Artificial Sequence
  Description of Artificial Sequence: Synthetic peptide
  Seed: HLVEALYLVC (INS_HUMAN)
HLVEALYLVM

SEQ ID NO: 34683 - protein, 11 aa, Artificial Sequence
  Description of Artificial Sequence: Synthetic peptide
  Seed: ALWGPDPAAAF (INS_HUMAN)
AGWGPDPAAAF

SEQ ID NO: 34684 - protein, 10 aa, Artificial Sequence
  Description of Artificial Sequence: Synthetic peptide
  Seed: SHLVEALYLV (INS_HUMAN)
SQLVEALYLI

SEQ ID NO: 34685 - protein, 10 aa, Artificial Sequence
  Description of Artificial Sequence: Synthetic peptide
  Seed: HLVEALYLVC (INS_HUMAN)
HMVEALYLVM

SEQ ID NO: 34686 - protein, 9 aa, Artificial Sequence
  Description of Artificial Sequence: Synthetic peptide
  Seed: ALWMRLLPL (INS_HUMAN)
ATWMRLLPV

SEQ ID NO: 34687 - protein, 9 aa, Artificial Sequence
  Description of Artificial Sequence: Synthetic peptide
  Seed: FVNQHLCGS (INS_HUMAN)
FQNQHLCGL

SEQ ID NO: 34688 - protein, 10 aa, Artificial Sequence
  Description of Artificial Sequence: Synthetic peptide
  Seed: LWGPDPAAAF (INS_HUMAN)
LLGPDPAAAY

SEQ ID NO: 34689 - protein, 9 aa, Artificial Sequence
  Description of Artificial Sequence: Synthetic peptide
  Seed: LALEGSLQK (INS_HUMAN)
LVLEGSLQM

SEQ ID NO: 34690 - protein, 9 aa, Artificial Sequence
  Description of Artificial Sequence: Synthetic peptide
  Seed: GPDPAAAFV (INS_HUMAN)
GLDPAAAFF

SEQ ID NO: 34691 - protein, 10 aa, Artificial Sequence
  Description of Artificial Sequence: Synthetic peptide
  Seed: HLVEALYLVC (INS_HUMAN)
HIVEALYLVV

SEQ ID NO: 34692 - protein, 9 aa, Artificial Sequence
  Description of Artificial Sequence: Synthetic peptide
  Seed: WGPDPAAAF (INS_HUMAN)
WSPDPAAAY

SEQ ID NO: 34693 - protein, 9 aa, Artificial Sequence
  Description of Artificial Sequence: Synthetic peptide
  Seed: AAAFVNQHL (INS_HUMAN)
AQAFVNQHF

SEQ ID NO: 34694 - protein, 9 aa, Artificial Sequence
  Description of Artificial Sequence: Synthetic peptide
  Seed: TSICSLYQL (INS_HUMAN)
TLICSLYQM

SEQ ID NO: 34695 - protein, 9 aa, Artificial Sequence
  Description of Artificial Sequence: Synthetic peptide
  Seed: MRLLPLLAL (INS_HUMAN)
MFLLPLLAL

SEQ ID NO: 34696 - protein, 9 aa, Artificial Sequence
  Description of Artificial Sequence: Synthetic peptide
  Seed: RLLPLLALL (INS_HUMAN)
RLLPLLALV

SEQ ID NO: 34697 - protein, 10 aa, Artificial Sequence
  Description of Artificial Sequence: Synthetic peptide
  Seed: MRLLPLLALL (INS_HUMAN)
MLLLPLLALV

SEQ ID NO: 34698 - protein, 10 aa, Artificial Sequence
  Description of Artificial Sequence: Synthetic peptide
  Seed: HLVEALYLVC (INS_HUMAN)
HLVEALYLVD

SEQ ID NO: 34699 - protein, 10 aa, Artificial Sequence
  Description of Artificial Sequence: Synthetic peptide
  Seed: SHLVEALYLV (INS_HUMAN)
SVLVEALYLA

SEQ ID NO: 34700 - protein, 11 aa, Artificial Sequence
  Description of Artificial Sequence: Synthetic peptide
  Seed: VELGGGPGAGS (INS_HUMAN)
VELGGGPGAGV

SEQ ID NO: 34701 - protein, 11 aa, Artificial Sequence
  Description of Artificial Sequence: Synthetic peptide
  Seed: ALWGPDPAAAF (INS_HUMAN)
ALWGPDPAAAI

SEQ ID NO: 34702 - protein, 9 aa, Artificial Sequence
  Description of Artificial Sequence: Synthetic peptide
  Seed: AAAFVNQHL (INS_HUMAN)
AAAFVNQHW

SEQ ID NO: 34703 - protein, 10 aa, Artificial Sequence
  Description of Artificial Sequence: Synthetic peptide
  Seed: HLCGSHLVEA (INS_HUMAN)
HMCGSHLVEV

SEQ ID NO: 34704 - protein, 9 aa, Artificial Sequence
  Description of Artificial Sequence: Synthetic peptide
  Seed: WGPDPAAAF (INS_HUMAN)
WMPDPAAAY

SEQ ID NO: 34705 - protein, 9 aa, Artificial Sequence
  Description of Artificial Sequence: Synthetic peptide
  Seed: TSICSLYQL (INS_HUMAN)
TAICSLYQI

SEQ ID NO: 34706 - protein, 9 aa, Artificial Sequence
  Description of Artificial Sequence: Synthetic peptide
  Seed: VCGERGFFY (INS_HUMAN)
VIGERGFFY

SEQ ID NO: 34707 - protein, 11 aa, Artificial Sequence
  Description of Artificial Sequence: Synthetic peptide
  Seed: MALWMRLLPLL (INS_HUMAN)
MFLWMRLLPLL

SEQ ID NO: 34708 - protein, 10 aa, Artificial Sequence
  Description of Artificial Sequence: Synthetic peptide
  Seed: ALWGPDPAAA (INS_HUMAN)
AAWGPDPAAV

SEQ ID NO: 34709 - protein, 11 aa, Artificial Sequence
  Description of Artificial Sequence: Synthetic peptide
  Seed: REAEDLQVGQV (INS_HUMAN)
RLAEDLQVGQL

SEQ ID NO: 34710 - protein, 10 aa, Artificial Sequence
  Description of Artificial Sequence: Synthetic peptide
  Seed: MRLLPLLALL (INS_HUMAN)
MELLPLLALA

SEQ ID NO: 34711 - protein, 10 aa, Artificial Sequence
  Description of Artificial Sequence: Synthetic peptide
  Seed: ALWGPDPAAA (INS_HUMAN)
AQWGPDPAAV

SEQ ID NO: 34712 - protein, 9 aa, Artificial Sequence
  Description of Artificial Sequence: Synthetic peptide
  Seed: VEALYLVCG (INS_HUMAN)
VEALYLVCA

SEQ ID NO: 34713 - protein, 10 aa, Artificial Sequence
  Description of Artificial Sequence: Synthetic peptide
  Seed: MALWMRLLPL (INS_HUMAN)
MMLWMRLLPY

SEQ ID NO: 34714 - protein, 9 aa, Artificial Sequence
  Description of Artificial Sequence: Synthetic peptide
  Seed: HLVEALYLV (INS_HUMAN)
HMVEALYLL

SEQ ID NO: 34715 - protein, 9 aa, Artificial Sequence
  Description of Artificial Sequence: Synthetic peptide
  Seed: FFYTPKTRR (INS_HUMAN)
FQYTPKTRR

SEQ ID NO: 34716 - protein, 11 aa, Artificial Sequence
  Description of Artificial Sequence: Synthetic peptide
  Seed: SHLVEALYLVC (INS_HUMAN)
SSLVEALYLVV

SEQ ID NO: 34717 - protein, 10 aa, Artificial Sequence
  Description of Artificial Sequence: Synthetic peptide
  Seed: RGFFYTPKTR (INS_HUMAN)
RWFFYTPKTR

SEQ ID NO: 34718 - protein, 11 aa, Artificial Sequence
  Description of Artificial Sequence: Synthetic peptide
  Seed: ALWGPDPAAAF (INS_HUMAN)
AQWGPDPAAAY

SEQ ID NO: 34719 - protein, 9 aa, Artificial Sequence
  Description of Artificial Sequence: Synthetic peptide
  Seed: NQHLCGSHL (INS_HUMAN)
NHHLCGSHY

SEQ ID NO: 34720 - protein, 10 aa, Artificial Sequence
  Description of Artificial Sequence: Synthetic peptide
  Seed: WGPDPAAAFV (INS_HUMAN)
WNPDPAAAFL

SEQ ID NO: 34721 - protein, 10 aa, Artificial Sequence
  Description of Artificial Sequence: Synthetic peptide
  Seed: LPLLALLALW (INS_HUMAN)
LPLLALLALL

SEQ ID NO: 34722 - protein, 10 aa, Artificial Sequence
  Description of Artificial Sequence: Synthetic peptide
  Seed: SHLVEALYLV (INS_HUMAN)
SKLVEALYLA

SEQ ID NO: 34723 - protein, 9 aa, Artificial Sequence
  Description of Artificial Sequence: Synthetic peptide
  Seed: AGSLQPLAL (INS_HUMAN)
AASLQPLAL

SEQ ID NO: 34724 - protein, 9 aa, Artificial Sequence
  Description of Artificial Sequence: Synthetic peptide
  Seed: AEDLQVGQV (INS_HUMAN)
AIDLQVGQI

SEQ ID NO: 34725 - protein, 10 aa, Artificial Sequence
  Description of Artificial Sequence: Synthetic peptide
  Seed: LWMRLLPLLA (INS_HUMAN)
LMMRLLPLLA

SEQ ID NO: 34726 - protein, 10 aa, Artificial Sequence
  Description of Artificial Sequence: Synthetic peptide
  Seed: WGPDPAAAFV (INS_HUMAN)
WFPDPAAAFL

SEQ ID NO: 34727 - protein, 11 aa, Artificial Sequence
  Description of Artificial Sequence: Synthetic peptide
  Seed: REAEDLQVGQV (INS_HUMAN)
RLAEDLQVGQW

SEQ ID NO: 34728 - protein, 11 aa, Artificial Sequence
  Description of Artificial Sequence: Synthetic peptide
  Seed: GSHLVEALYLV (INS_HUMAN)
GAHLVEALYLL

SEQ ID NO: 34729 - protein, 10 aa, Artificial Sequence
  Description of Artificial Sequence: Synthetic peptide
  Seed: MALWMRLLPL (INS_HUMAN)
MMLWMRLLPV

SEQ ID NO: 34730 - protein, 10 aa, Artificial Sequence
  Description of Artificial Sequence: Synthetic peptide
  Seed: ALWGPDPAAA (INS_HUMAN)
ALWGPDPAAI

SEQ ID NO: 34731 - protein, 8 aa, Artificial Sequence
  Description of Artificial Sequence: Synthetic peptide
  Seed: GPDPAAAF (INS_HUMAN)
GSDPAAAI

SEQ ID NO: 34732 - protein, 9 aa, Artificial Sequence
  Description of Artificial Sequence: Synthetic peptide
  Seed: ALWMRLLPL (INS_HUMAN)
AMWMRLLPL

SEQ ID NO: 34733 - protein, 9 aa, Artificial Sequence
  Description of Artificial Sequence: Synthetic peptide
  Seed: GPDPAAAFV (INS_HUMAN)
GYDPAAAFV

SEQ ID NO: 34734 - protein, 10 aa, Artificial Sequence
  Description of Artificial Sequence: Synthetic peptide
  Seed: RLLPLLALLA (INS_HUMAN)
RVLPLLALLI

SEQ ID NO: 34735 - protein, 10 aa, Artificial Sequence
  Description of Artificial Sequence: Synthetic peptide
  Seed: MRLLPLLALL (INS_HUMAN)
MKLLPLLALI

SEQ ID NO: 34736 - protein, 10 aa, Artificial Sequence
  Description of Artificial Sequence: Synthetic peptide
  Seed: MRLLPLLALL (INS_HUMAN)
MYLLPLLALL

SEQ ID NO: 34737 - protein, 9 aa, Artificial Sequence
  Description of Artificial Sequence: Synthetic peptide
  Seed: AAAFVNQHL (INS_HUMAN)
AAAFVNQHV

SEQ ID NO: 34738 - protein, 10 aa, Artificial Sequence
  Description of Artificial Sequence: Synthetic peptide
  Seed: ALWGPDPAAA (INS_HUMAN)
ALWGPDPAAR

SEQ ID NO: 34739 - protein, 11 aa, Artificial Sequence
  Description of Artificial Sequence: Synthetic peptide
  Seed: WMRLLPLLALL (INS_HUMAN)
WCRLLPLLALL

SEQ ID NO: 34740 - protein, 10 aa, Artificial Sequence
  Description of Artificial Sequence: Synthetic peptide
  Seed: RLLPLLALLA (INS_HUMAN)
RTLPLLALLV

SEQ ID NO: 34741 - protein, 11 aa, Artificial Sequence
  Description of Artificial Sequence: Synthetic peptide
  Seed: GSHLVEALYLV (INS_HUMAN)
GMHLVEALYLV

SEQ ID NO: 34742 - protein, 9 aa, Artificial Sequence
  Description of Artificial Sequence: Synthetic peptide
  Seed: AAAFVNQHL (INS_HUMAN)
AQAFVNQHW

SEQ ID NO: 34743 - protein, 11 aa, Artificial Sequence
  Description of Artificial Sequence: Synthetic peptide
  Seed: MALWMRLLPLL (INS_HUMAN)
MYLWMRLLPLI

SEQ ID NO: 34744 - protein, 10 aa, Artificial Sequence
  Description of Artificial Sequence: Synthetic peptide
  Seed: MRLLPLLALL (INS_HUMAN)
MKLLPLLALM

SEQ ID NO: 34745 - protein, 10 aa, Artificial Sequence
  Description of Artificial Sequence: Synthetic peptide
  Seed: LLPLLALLAL (INS_HUMAN)
LFPLLALLAL

SEQ ID NO: 34746 - protein, 10 aa, Artificial Sequence
  Description of Artificial Sequence: Synthetic peptide
  Seed: RLLPLLALLA (INS_HUMAN)
RLLPLLALLQ

SEQ ID NO: 34747 - protein, 8 aa, Artificial Sequence
  Description of Artificial Sequence: Synthetic peptide
  Seed: GPDPAAAF (INS_HUMAN)
GSDPAAAL

SEQ ID NO: 34748 - protein, 10 aa, Artificial Sequence
  Description of Artificial Sequence: Synthetic peptide
  Seed: MALWMRLLPL (INS_HUMAN)
MILWMRLLPM

SEQ ID NO: 34749 - protein, 9 aa, Artificial Sequence
  Description of Artificial Sequence: Synthetic peptide
  Seed: ALWMRLLPL (INS_HUMAN)
AIWMRLLPL

SEQ ID NO: 34750 - protein, 10 aa, Artificial Sequence
  Description of Artificial Sequence: Synthetic peptide
  Seed: RLLPLLALLA (INS_HUMAN)
RLLPLLALLH

SEQ ID NO: 34751 - protein, 10 aa, Artificial Sequence
  Description of Artificial Sequence: Synthetic peptide
  Seed: ALWMRLLPLL (INS_HUMAN)
AMWMRLLPLA

SEQ ID NO: 34752 - protein, 9 aa, Artificial Sequence
  Description of Artificial Sequence: Synthetic peptide
  Seed: AEDLQVGQV (INS_HUMAN)
ALDLQVGQL

SEQ ID NO: 34753 - protein, 9 aa, Artificial Sequence
  Description of Artificial Sequence: Synthetic peptide
  Seed: MRLLPLLAL (INS_HUMAN)
MRLLPLLAF

SEQ ID NO: 34754 - protein, 9 aa, Artificial Sequence
  Description of Artificial Sequence: Synthetic peptide
  Seed: RLLPLLALL (INS_HUMAN)
RSLPLLALL

SEQ ID NO: 34755 - protein, 11 aa, Artificial Sequence
  Description of Artificial Sequence: Synthetic peptide
  Seed: ALWGPDPAAAF (INS_HUMAN)
ATWGPDPAAAM

SEQ ID NO: 34756 - protein, 9 aa, Artificial Sequence
  Description of Artificial Sequence: Synthetic peptide
  Seed: HLVEALYLV (INS_HUMAN)
HSVEALYLI

SEQ ID NO: 34757 - protein, 9 aa, Artificial Sequence
  Description of Artificial Sequence: Synthetic peptide
  Seed: RLLPLLALL (INS_HUMAN)
RWLPLLALM

SEQ ID NO: 34758 - protein, 9 aa, Artificial Sequence
  Description of Artificial Sequence: Synthetic peptide
  Seed: MRLLPLLAL (INS_HUMAN)
MLLLPLLAF

SEQ ID NO: 34759 - protein, 9 aa, Artificial Sequence
  Description of Artificial Sequence: Synthetic peptide
  Seed: RLLPLLALL (INS_HUMAN)
RYLPLLALL

SEQ ID NO: 34760 - protein, 9 aa, Artificial Sequence
  Description of Artificial Sequence: Synthetic peptide
  Seed: YLVCGERGF (INS_HUMAN)
YMVCGERGM

SEQ ID NO: 34761 - protein, 9 aa, Artificial Sequence
  Description of Artificial Sequence: Synthetic peptide
  Seed: FVNQHLCGS (INS_HUMAN)
FMNQHLCGL

SEQ ID NO: 34762 - protein, 10 aa, Artificial Sequence
  Description of Artificial Sequence: Synthetic peptide
  Seed: MALWMRLLPL (INS_HUMAN)
MVLWMRLLPF

SEQ ID NO: 34763 - protein, 9 aa, Artificial Sequence
  Description of Artificial Sequence: Synthetic peptide
  Seed: RLLPLLALL (INS_HUMAN)
RFLPLLALM

SEQ ID NO: 34764 - protein, 10 aa, Artificial Sequence
  Description of Artificial Sequence: Synthetic peptide
  Seed: LWMRLLPLLA (INS_HUMAN)
LVMRLLPLLV

SEQ ID NO: 34765 - protein, 9 aa, Artificial Sequence
  Description of Artificial Sequence: Synthetic peptide
  Seed: TSICSLYQL (INS_HUMAN)
TVICSLYQL

SEQ ID NO: 34766 - protein, 11 aa, Artificial Sequence
  Description of Artificial Sequence: Synthetic peptide
  Seed: ALWGPDPAAAF (INS_HUMAN)
AEWGPDPAAAF

SEQ ID NO: 34767 - protein, 10 aa, Artificial Sequence
  Description of Artificial Sequence: Synthetic peptide
  Seed: MRLLPLLALL (INS_HUMAN)
MYLLPLLALV

SEQ ID NO: 34768 - protein, 9 aa, Artificial Sequence
  Description of Artificial Sequence: Synthetic peptide
  Seed: TSICSLYQL (INS_HUMAN)
TAICSLYQV

SEQ ID NO: 34769 - protein, 10 aa, Artificial Sequence
  Description of Artificial Sequence: Synthetic peptide
  Seed: LWGPDPAAAF (INS_HUMAN)
LYGPDPAAAF

SEQ ID NO: 34770 - protein, 10 aa, Artificial Sequence
  Description of Artificial Sequence: Synthetic peptide
  Seed: MALWMRLLPL (INS_HUMAN)
MLLWMRLLPV

SEQ ID NO: 34771 - protein, 9 aa, Artificial Sequence
  Description of Artificial Sequence: Synthetic peptide
  Seed: AEDLQVGQV (INS_HUMAN)
AGDLQVGQL

SEQ ID NO: 34772 - protein, 9 aa, Artificial Sequence
  Description of Artificial Sequence: Synthetic peptide
  Seed: FVNQHLCGS (INS_HUMAN)
FINQHLCGL

SEQ ID NO: 34773 - protein, 10 aa, Artificial Sequence
  Description of Artificial Sequence: Synthetic peptide
  Seed: WMRLLPLLAL (INS_HUMAN)
WQRLLPLLAI

SEQ ID NO: 34774 - protein, 10 aa, Artificial Sequence
  Description of Artificial Sequence: Synthetic peptide
  Seed: MALWMRLLPL (INS_HUMAN)
MFLWMRLLPY

SEQ ID NO: 34775 - protein, 11 aa, Artificial Sequence
  Description of Artificial Sequence: Synthetic peptide
  Seed: ALWGPDPAAAF (INS_HUMAN)
AHWGPDPAAAF

SEQ ID NO: 34776 - protein, 9 aa, Artificial Sequence
  Description of Artificial Sequence: Synthetic peptide
  Seed: ALWMRLLPL (INS_HUMAN)
AVWMRLLPR

SEQ ID NO: 34777 - protein, 9 aa, Artificial Sequence
  Description of Artificial Sequence: Synthetic peptide
  Seed: GSHLVEALY (INS_HUMAN)
GLHLVEALF

SEQ ID NO: 34778 - protein, 9 aa, Artificial Sequence
  Description of Artificial Sequence: Synthetic peptide
  Seed: AGSLQPLAL (INS_HUMAN)
ASSLQPLAY

SEQ ID NO: 34779 - protein, 10 aa, Artificial Sequence
  Description of Artificial Sequence: Synthetic peptide
  Seed: LALEGSLQKR (INS_HUMAN)
LTLEGSLQKK

SEQ ID NO: 34780 - protein, 9 aa, Artificial Sequence
  Description of Artificial Sequence: Synthetic peptide
  Seed: GPDPAAAFV (INS_HUMAN)
GIDPAAAFI

SEQ ID NO: 34781 - protein, 9 aa, Artificial Sequence
  Description of Artificial Sequence: Synthetic peptide
  Seed: CGSHLVEAL (INS_HUMAN)
CASHLVEAL

SEQ ID NO: 34782 - protein, 9 aa, Artificial Sequence
  Description of Artificial Sequence: Synthetic peptide
  Seed: AAAFVNQHL (INS_HUMAN)
AMAFVNQHW

SEQ ID NO: 34783 - protein, 9 aa, Artificial Sequence
  Description of Artificial Sequence: Synthetic peptide
  Seed: AAAFVNQHL (INS_HUMAN)
AMAFVNQHL

SEQ ID NO: 34784 - protein, 11 aa, Artificial Sequence
  Description of Artificial Sequence: Synthetic peptide
  Seed: ALWGPDPAAAF (INS_HUMAN)
AAWGPDPAAAH

SEQ ID NO: 34785 - protein, 11 aa, Artificial Sequence
  Description of Artificial Sequence: Synthetic peptide
  Seed: ALWMRLLPLLA (INS_HUMAN)
AMWMRLLPLLI

SEQ ID NO: 34786 - protein, 9 aa, Artificial Sequence
  Description of Artificial Sequence: Synthetic peptide
  Seed: MRLLPLLAL (INS_HUMAN)
MQLLPLLAF

SEQ ID NO: 34787 - protein, 10 aa, Artificial Sequence
  Description of Artificial Sequence: Synthetic peptide
  Seed: WMRLLPLLAL (INS_HUMAN)
WDRLLPLLAK

SEQ ID NO: 34788 - protein, 9 aa, Artificial Sequence
  Description of Artificial Sequence: Synthetic peptide
  Seed: AAAFVNQHL (INS_HUMAN)
ATAFVNQHW

SEQ ID NO: 34789 - protein, 11 aa, Artificial Sequence
  Description of Artificial Sequence: Synthetic peptide
  Seed: GSHLVEALYLV (INS_HUMAN)
GVHLVEALYLI

SEQ ID NO: 34790 - protein, 9 aa, Artificial Sequence
  Description of Artificial Sequence: Synthetic peptide
  Seed: WGPDPAAAF (INS_HUMAN)
WPPDPAAAY

SEQ ID NO: 34791 - protein, 9 aa, Artificial Sequence
  Description of Artificial Sequence: Synthetic peptide
  Seed: RLLPLLALL (INS_HUMAN)
RQLPLLALY

SEQ ID NO: 34792 - protein, 9 aa, Artificial Sequence
  Description of Artificial Sequence: Synthetic peptide
  Seed: HLVEALYLV (INS_HUMAN)
HVVEALYLT

SEQ ID NO: 34793 - protein, 9 aa, Artificial Sequence
  Description of Artificial Sequence: Synthetic peptide
  Seed: AGSLQPLAL (INS_HUMAN)
APSLQPLAA

SEQ ID NO: 34794 - protein, 10 aa, Artificial Sequence
  Description of Artificial Sequence: Synthetic peptide
  Seed: MALWMRLLPL (INS_HUMAN)
MQLWMRLLPM

SEQ ID NO: 34795 - protein, 9 aa, Artificial Sequence
  Description of Artificial Sequence: Synthetic peptide
  Seed: AEDLQVGQV (INS_HUMAN)
AEDLQVGQW

SEQ ID NO: 34796 - protein, 9 aa, Artificial Sequence
  Description of Artificial Sequence: Synthetic peptide
  Seed: MRLLPLLAL (INS_HUMAN)
MALLPLLAM

SEQ ID NO: 34797 - protein, 10 aa, Artificial Sequence
  Description of Artificial Sequence: Synthetic peptide
  Seed: WGPDPAAAFV (INS_HUMAN)
WAPDPAAAFL

SEQ ID NO: 34798 - protein, 10 aa, Artificial Sequence
  Description of Artificial Sequence: Synthetic peptide
  Seed: WMRLLPLLAL (INS_HUMAN)
WMRLLPLLAM

SEQ ID NO: 34799 - protein, 9 aa, Artificial Sequence
  Description of Artificial Sequence: Synthetic peptide
  Seed: RLLPLLALL (INS_HUMAN)
RTLPLLALK

SEQ ID NO: 34800 - protein, 11 aa, Artificial Sequence
  Description of Artificial Sequence: Synthetic peptide
  Seed: REAEDLQVGQV (INS_HUMAN)
RIAEDLQVGQF

SEQ ID NO: 34801 - protein, 10 aa, Artificial Sequence
  Description of Artificial Sequence: Synthetic peptide
  Seed: MRLLPLLALL (INS_HUMAN)
MALLPLLALL

SEQ ID NO: 34802 - protein, 11 aa, Artificial Sequence
  Description of Artificial Sequence: Synthetic peptide
  Seed: MALWMRLLPLL (INS_HUMAN)
MMLWMRLLPLI

SEQ ID NO: 34803 - protein, 9 aa, Artificial Sequence
  Description of Artificial Sequence: Synthetic peptide
  Seed: FVNQHLCGS (INS_HUMAN)
FSNQHLCGI

SEQ ID NO: 34804 - protein, 9 aa, Artificial Sequence
  Description of Artificial Sequence: Synthetic peptide
  Seed: DLQVGQVEL (INS_HUMAN)
DRQVGQVEL

SEQ ID NO: 34805 - protein, 10 aa, Artificial Sequence
  Description of Artificial Sequence: Synthetic peptide
  Seed: MALWMRLLPL (INS_HUMAN)
MMLWMRLLPT

SEQ ID NO: 34806 - protein, 11 aa, Artificial Sequence
  Description of Artificial Sequence: Synthetic peptide
  Seed: ALWGPDPAAAF (INS_HUMAN)
AFWGPDPAAAY

SEQ ID NO: 34807 - protein, 9 aa, Artificial Sequence
  Description of Artificial Sequence: Synthetic peptide
  Seed: HLVEALYLV (INS_HUMAN)
HMVEALYLI

SEQ ID NO: 34808 - protein, 9 aa, Artificial Sequence
  Description of Artificial Sequence: Synthetic peptide
  Seed: LWMRLLPLL (INS_HUMAN)
LFMRLLPLI

SEQ ID NO: 34809 - protein, 11 aa, Artificial Sequence
  Description of Artificial Sequence: Synthetic peptide
  Seed: REAEDLQVGQV (INS_HUMAN)
RVAEDLQVGQL

SEQ ID NO: 34810 - protein, 10 aa, Artificial Sequence
  Description of Artificial Sequence: Synthetic peptide
  Seed: MALWMRLLPL (INS_HUMAN)
MYLWMRLLPL

SEQ ID NO: 34811 - protein, 9 aa, Artificial Sequence
  Description of Artificial Sequence: Synthetic peptide
  Seed: AEDLQVGQV (INS_HUMAN)
AVDLQVGQM

SEQ ID NO: 34812 - protein, 11 aa, Artificial Sequence
  Description of Artificial Sequence: Synthetic peptide
  Seed: REAEDLQVGQV (INS_HUMAN)
RMAEDLQVGQW

SEQ ID NO: 34813 - protein, 9 aa, Artificial Sequence
  Description of Artificial Sequence: Synthetic peptide
  Seed: HLVEALYLV (INS_HUMAN)
HMVEALYLC

SEQ ID NO: 34814 - protein, 10 aa, Artificial Sequence
  Description of Artificial Sequence: Synthetic peptide
  Seed: MALWMRLLPL (INS_HUMAN)
MHLWMRLLPM

SEQ ID NO: 34815 - protein, 10 aa, Artificial Sequence
  Description of Artificial Sequence: Synthetic peptide
  Seed: ALWMRLLPLL (INS_HUMAN)
ALWMRLLPLM

SEQ ID NO: 34816 - protein, 9 aa, Artificial Sequence
  Description of Artificial Sequence: Synthetic peptide
  Seed: NQHLCGSHL (INS_HUMAN)
NHHLCGSHM

SEQ ID NO: 34817 - protein, 10 aa, Artificial Sequence
  Description of Artificial Sequence: Synthetic peptide
  Seed: WMRLLPLLAL (INS_HUMAN)
WGRLLPLLAL

SEQ ID NO: 34818 - protein, 10 aa, Artificial Sequence
  Description of Artificial Sequence: Synthetic peptide
  Seed: VNQHLCGSHL (INS_HUMAN)
VTQHLCGSHF

SEQ ID NO: 34819 - protein, 10 aa, Artificial Sequence
  Description of Artificial Sequence: Synthetic peptide
  Seed: MALWMRLLPL (INS_HUMAN)
MKLWMRLLPL

SEQ ID NO: 34820 - protein, 10 aa, Artificial Sequence
  Description of Artificial Sequence: Synthetic peptide
  Seed: WMRLLPLLAL (INS_HUMAN)
WTRLLPLLAL

SEQ ID NO: 34821 - protein, 10 aa, Artificial Sequence
  Description of Artificial Sequence: Synthetic peptide
  Seed: REAEDLQVGQ (INS_HUMAN)
REAEDLQVGW

SEQ ID NO: 34822 - protein, 9 aa, Artificial Sequence
  Description of Artificial Sequence: Synthetic peptide
  Seed: ALWMRLLPL (INS_HUMAN)
ATWMRLLPW

SEQ ID NO: 34823 - protein, 9 aa, Artificial Sequence
  Description of Artificial Sequence: Synthetic peptide
  Seed: LALEGSLQK (INS_HUMAN)
LVLEGSLQK

SEQ ID NO: 34824 - protein, 10 aa, Artificial Sequence
  Description of Artificial Sequence: Synthetic peptide
  Seed: LALWGPDPAA (INS_HUMAN)
LSLWGPDPAV

SEQ ID NO: 34825 - protein, 9 aa, Artificial Sequence
  Description of Artificial Sequence: Synthetic peptide
  Seed: LPLLALLAL (INS_HUMAN)
LQLLALLAY

SEQ ID NO: 34826 - protein, 10 aa, Artificial Sequence
  Description of Artificial Sequence: Synthetic peptide
  Seed: VNQHLCGSHL (INS_HUMAN)
VQQHLCGSHF

SEQ ID NO: 34827 - protein, 11 aa, Artificial Sequence
  Description of Artificial Sequence: Synthetic peptide
  Seed: SHLVEALYLVC (INS_HUMAN)
SMLVEALYLVT

SEQ ID NO: 34828 - protein, 9 aa, Artificial Sequence
  Description of Artificial Sequence: Synthetic peptide
  Seed: QPLALEGSL (INS_HUMAN)
QPLALEGSF

SEQ ID NO: 34829 - protein, 10 aa, Artificial Sequence
  Description of Artificial Sequence: Synthetic peptide
  Seed: LLPLLALLAL (INS_HUMAN)
LGPLLALLAL

SEQ ID NO: 34830 - protein, 11 aa, Artificial Sequence
  Description of Artificial Sequence: Synthetic peptide
  Seed: LALWGPDPAAA (INS_HUMAN)
LPLWGPDPAAL

SEQ ID NO: 34831 - protein, 9 aa, Artificial Sequence
  Description of Artificial Sequence: Synthetic peptide
  Seed: RLLPLLALL (INS_HUMAN)
RVLPLLALK

SEQ ID NO: 34832 - protein, 9 aa, Artificial Sequence
  Description of Artificial Sequence: Synthetic peptide
  Seed: MRLLPLLAL (INS_HUMAN)
MRLLPLLAY

SEQ ID NO: 34833 - protein, 11 aa, Artificial Sequence
  Description of Artificial Sequence: Synthetic peptide
  Seed: ALWGPDPAAAF (INS_HUMAN)
ATWGPDPAAAW

SEQ ID NO: 34834 - protein, 10 aa, Artificial Sequence
  Description of Artificial Sequence: Synthetic peptide
  Seed: VNQHLCGSHL (INS_HUMAN)
VGQHLCGSHY

SEQ ID NO: 34835 - protein, 9 aa, Artificial Sequence
  Description of Artificial Sequence: Synthetic peptide
  Seed: CSLYQLENY (INS_HUMAN)
CTLYQLENW

SEQ ID NO: 34836 - protein, 10 aa, Artificial Sequence
  Description of Artificial Sequence: Synthetic peptide
  Seed: SHLVEALYLV (INS_HUMAN)
SILVEALYLL

SEQ ID NO: 34837 - protein, 11 aa, Artificial Sequence
  Description of Artificial Sequence: Synthetic peptide
  Seed: RGFFYTPKTRR (INS_HUMAN)
RHFFYTPKTRR

SEQ ID NO: 34838 - protein, 9 aa, Artificial Sequence
  Description of Artificial Sequence: Synthetic peptide
  Seed: GPDPAAAFV (INS_HUMAN)
GQDPAAAFM

SEQ ID NO: 34839 - protein, 10 aa, Artificial Sequence
  Description of Artificial Sequence: Synthetic peptide
  Seed: WMRLLPLLAL (INS_HUMAN)
WFRLLPLLAM

SEQ ID NO: 34840 - protein, 10 aa, Artificial Sequence
  Description of Artificial Sequence: Synthetic peptide
  Seed: MRLLPLLALL (INS_HUMAN)
MGLLPLLALV

SEQ ID NO: 34841 - protein, 9 aa, Artificial Sequence
  Description of Artificial Sequence: Synthetic peptide
  Seed: WGPDPAAAF (INS_HUMAN)
WAPDPAAAF

SEQ ID NO: 34842 - protein, 9 aa, Artificial Sequence
  Description of Artificial Sequence: Synthetic peptide
  Seed: ALEGSLQKR (INS_HUMAN)
AVEGSLQKY

SEQ ID NO: 34843 - protein, 10 aa, Artificial Sequence
  Description of Artificial Sequence: Synthetic peptide
  Seed: WMRLLPLLAL (INS_HUMAN)
WPRLLPLLAK

SEQ ID NO: 34844 - protein, 9 aa, Artificial Sequence
  Description of Artificial Sequence: Synthetic peptide
  Seed: LPLLALLAL (INS_HUMAN)
LALLALLAF

SEQ ID NO: 34845 - protein, 9 aa, Artificial Sequence
  Description of Artificial Sequence: Synthetic peptide
  Seed: RLLPLLALL (INS_HUMAN)
RNLPLLALY

SEQ ID NO: 34846 - protein, 10 aa, Artificial Sequence
  Description of Artificial Sequence: Synthetic peptide
  Seed: REAEDLQVGQ (INS_HUMAN)
REAEDLQVGC

SEQ ID NO: 34847 - protein, 9 aa, Artificial Sequence
  Description of Artificial Sequence: Synthetic peptide
  Seed: AAAFVNQHL (INS_HUMAN)
AMAFVNQHA

SEQ ID NO: 34848 - protein, 9 aa, Artificial Sequence
  Description of Artificial Sequence: Synthetic peptide
  Seed: TSICSLYQL (INS_HUMAN)
TLICSLYQT

SEQ ID NO: 34849 - protein, 9 aa, Artificial Sequence
  Description of Artificial Sequence: Synthetic peptide
  Seed: AEDLQVGQV (INS_HUMAN)
AGDLQVGQF

SEQ ID NO: 34850 - protein, 11 aa, Artificial Sequence
  Description of Artificial Sequence: Synthetic peptide
  Seed: RGFFYTPKTRR (INS_HUMAN)
RFFFYTPKTRK

SEQ ID NO: 34851 - protein, 10 aa, Artificial Sequence
  Description of Artificial Sequence: Synthetic peptide
  Seed: HLVEALYLVC (INS_HUMAN)
HMVEALYLVY

SEQ ID NO: 34852 - protein, 11 aa, Artificial Sequence
  Description of Artificial Sequence: Synthetic peptide
  Seed: YLVCGERGFFY (INS_HUMAN)
YMVCGERGFFY

SEQ ID NO: 34853 - protein, 9 aa, Artificial Sequence
  Description of Artificial Sequence: Synthetic peptide
  Seed: WGPDPAAAF (INS_HUMAN)
WIPDPAAAM

SEQ ID NO: 34854 - protein, 9 aa, Artificial Sequence
  Description of Artificial Sequence: Synthetic peptide
  Seed: PLLALLALW (INS_HUMAN)
PTLALLALW

SEQ ID NO: 34855 - protein, 9 aa, Artificial Sequence
  Description of Artificial Sequence: Synthetic peptide
  Seed: FVNQHLCGS (INS_HUMAN)
FSNQHLCGV

SEQ ID NO: 34856 - protein, 11 aa, Artificial Sequence
  Description of Artificial Sequence: Synthetic peptide
  Seed: WMRLLPLLALL (INS_HUMAN)
WFRLLPLLALI

SEQ ID NO: 34857 - protein, 9 aa, Artificial Sequence
  Description of Artificial Sequence: Synthetic peptide
  Seed: ALWMRLLPL (INS_HUMAN)
ALWMRLLPS

SEQ ID NO: 34858 - protein, 9 aa, Artificial Sequence
  Description of Artificial Sequence: Synthetic peptide
  Seed: RLLPLLALL (INS_HUMAN)
RRLPLLALA

SEQ ID NO: 34859 - protein, 8 aa, Artificial Sequence
  Description of Artificial Sequence: Synthetic peptide
  Seed: GPDPAAAF (INS_HUMAN)
GADPAAAV

SEQ ID NO: 34860 - protein, 10 aa, Artificial Sequence
  Description of Artificial Sequence: Synthetic peptide
  Seed: SHLVEALYLV (INS_HUMAN)
SLLVEALYLT

SEQ ID NO: 34861 - protein, 10 aa, Artificial Sequence
  Description of Artificial Sequence: Synthetic peptide
  Seed: LALEGSLQKR (INS_HUMAN)
LTLEGSLQKR

SEQ ID NO: 34862 - protein, 10 aa, Artificial Sequence
  Description of Artificial Sequence: Synthetic peptide
  Seed: ALWGPDPAAA (INS_HUMAN)
AIWGPDPAAV

SEQ ID NO: 34863 - protein, 9 aa, Artificial Sequence
  Description of Artificial Sequence: Synthetic peptide
  Seed: WGPDPAAAF (INS_HUMAN)
WLPDPAAAF

SEQ ID NO: 34864 - protein, 10 aa, Artificial Sequence
  Description of Artificial Sequence: Synthetic peptide
  Seed: RGFFYTPKTR (INS_HUMAN)
RFFFYTPKTK

SEQ ID NO: 34865 - protein, 9 aa, Artificial Sequence
  Description of Artificial Sequence: Synthetic peptide
  Seed: WGPDPAAAF (INS_HUMAN)
WRPDPAAAM

SEQ ID NO: 34866 - protein, 10 aa, Artificial Sequence
  Description of Artificial Sequence: Synthetic peptide
  Seed: SHLVEALYLV (INS_HUMAN)
SDLVEALYLL

SEQ ID NO: 34867 - protein, 10 aa, Artificial Sequence
  Description of Artificial Sequence: Synthetic peptide
  Seed: ALWGPDPAAA (INS_HUMAN)
AIWGPDPAAI

SEQ ID NO: 34868 - protein, 10 aa, Artificial Sequence
  Description of Artificial Sequence: Synthetic peptide
  Seed: SHLVEALYLV (INS_HUMAN)
SQLVEALYLA

SEQ ID NO: 34869 - protein, 8 aa, Artificial Sequence
  Description of Artificial Sequence: Synthetic peptide
  Seed: RGFFYTPK (INS_HUMAN)
RSFFYTPK

SEQ ID NO: 34870 - protein, 9 aa, Artificial Sequence
  Description of Artificial Sequence: Synthetic peptide
  Seed: GERGFFYTP (INS_HUMAN)
GERGFFYTF

SEQ ID NO: 34871 - protein, 9 aa, Artificial Sequence
  Description of Artificial Sequence: Synthetic peptide
  Seed: FFYTPKTRR (INS_HUMAN)
FGYTPKTRR

SEQ ID NO: 34872 - protein, 10 aa, Artificial Sequence
  Description of Artificial Sequence: Synthetic peptide
  Seed: MRLLPLLALL (INS_HUMAN)
MWLLPLLALM

SEQ ID NO: 34873 - protein, 9 aa, Artificial Sequence
  Description of Artificial Sequence: Synthetic peptide
  Seed: LALEGSLQK (INS_HUMAN)
LTLEGSLQF

SEQ ID NO: 34874 - protein, 9 aa, Artificial Sequence
  Description of Artificial Sequence: Synthetic peptide
  Seed: MRLLPLLAL (INS_HUMAN)
MYLLPLLAV

SEQ ID NO: 34875 - protein, 8 aa, Artificial Sequence
  Description of Artificial Sequence: Synthetic peptide
  Seed: RGFFYTPK (INS_HUMAN)
RFFFYTPR

SEQ ID NO: 34876 - protein, 11 aa, Artificial Sequence
  Description of Artificial Sequence: Synthetic peptide
  Seed: RLLPLLALLAL (INS_HUMAN)
RLLPLLALLAI

SEQ ID NO: 34877 - protein, 10 aa, Artificial Sequence
  Description of Artificial Sequence: Synthetic peptide
  Seed: HLVEALYLVC (INS_HUMAN)
HLVEALYLVR

SEQ ID NO: 34878 - protein, 10 aa, Artificial Sequence
  Description of Artificial Sequence: Synthetic peptide
  Seed: SHLVEALYLV (INS_HUMAN)
SMLVEALYLV

SEQ ID NO: 34879 - protein, 10 aa, Artificial Sequence
  Description of Artificial Sequence: Synthetic peptide
  Seed: ALWMRLLPLL (INS_HUMAN)
ARWMRLLPLW

SEQ ID NO: 34880 - protein, 10 aa, Artificial Sequence
  Description of Artificial Sequence: Synthetic peptide
  Seed: SHLVEALYLV (INS_HUMAN)
SRLVEALYLI

SEQ ID NO: 34881 - protein, 9 aa, Artificial Sequence
  Description of Artificial Sequence: Synthetic peptide
  Seed: HLVEALYLV (INS_HUMAN)
HLVEALYLT

SEQ ID NO: 34882 - protein, 10 aa, Artificial Sequence
  Description of Artificial Sequence: Synthetic peptide
  Seed: MRLLPLLALL (INS_HUMAN)
MFLLPLLALA

SEQ ID NO: 34883 - protein, 11 aa, Artificial Sequence
  Description of Artificial Sequence: Synthetic peptide
  Seed: WMRLLPLLALL (INS_HUMAN)
WPRLLPLLALL

SEQ ID NO: 34884 - protein, 9 aa, Artificial Sequence
  Description of Artificial Sequence: Synthetic peptide
  Seed: ALWMRLLPL (INS_HUMAN)
ATWMRLLPR

SEQ ID NO: 34885 - protein, 9 aa, Artificial Sequence
  Description of Artificial Sequence: Synthetic peptide
  Seed: WGPDPAAAF (INS_HUMAN)
WYPDPAAAI

SEQ ID NO: 34886 - protein, 10 aa, Artificial Sequence
  Description of Artificial Sequence: Synthetic peptide
  Seed: MRLLPLLALL (INS_HUMAN)
MDLLPLLALI

SEQ ID NO: 34887 - protein, 10 aa, Artificial Sequence
  Description of Artificial Sequence: Synthetic peptide
  Seed: MRLLPLLALL (INS_HUMAN)
MMLLPLLALI

SEQ ID NO: 34888 - protein, 11 aa, Artificial Sequence
  Description of Artificial Sequence: Synthetic peptide
  Seed: SHLVEALYLVC (INS_HUMAN)
SMLVEALYLVM

SEQ ID NO: 34889 - protein, 10 aa, Artificial Sequence
  Description of Artificial Sequence: Synthetic peptide
  Seed: WGPDPAAAFV (INS_HUMAN)
WTPDPAAAFL

SEQ ID NO: 34890 - protein, 10 aa, Artificial Sequence
  Description of Artificial Sequence: Synthetic peptide
  Seed: ALWMRLLPLL (INS_HUMAN)
ATWMRLLPLV

SEQ ID NO: 34891 - protein, 10 aa, Artificial Sequence
  Description of Artificial Sequence: Synthetic peptide
  Seed: MALWMRLLPL (INS_HUMAN)
MFLWMRLLPV

SEQ ID NO: 34892 - protein, 10 aa, Artificial Sequence
  Description of Artificial Sequence: Synthetic peptide
  Seed: LLPLLALLAL (INS_HUMAN)
LFPLLALLAY

SEQ ID NO: 34893 - protein, 10 aa, Artificial Sequence
  Description of Artificial Sequence: Synthetic peptide
  Seed: LALWGPDPAA (INS_HUMAN)
LFLWGPDPAI

SEQ ID NO: 34894 - protein, 9 aa, Artificial Sequence
  Description of Artificial Sequence: Synthetic peptide
  Seed: MRLLPLLAL (INS_HUMAN)
MHLLPLLAF

SEQ ID NO: 34895 - protein, 9 aa, Artificial Sequence
  Description of Artificial Sequence: Synthetic peptide
  Seed: RLLPLLALL (INS_HUMAN)
RTLPLLALM

SEQ ID NO: 34896 - protein, 9 aa, Artificial Sequence
  Description of Artificial Sequence: Synthetic peptide
  Seed: CCTSICSLY (INS_HUMAN)
CMTSICSLY

SEQ ID NO: 34897 - protein, 10 aa, Artificial Sequence
  Description of Artificial Sequence: Synthetic peptide
  Seed: RLLPLLALLA (INS_HUMAN)
RILPLLALLI

SEQ ID NO: 34898 - protein, 11 aa, Artificial Sequence
  Description of Artificial Sequence: Synthetic peptide
  Seed: SHLVEALYLVC (INS_HUMAN)
SLLVEALYLVP

SEQ ID NO: 34899 - protein, 9 aa, Artificial Sequence
  Description of Artificial Sequence: Synthetic peptide
  Seed: YTPKTRREA (INS_HUMAN)
YTPKTRREY

SEQ ID NO: 34900 - protein, 9 aa, Artificial Sequence
  Description of Artificial Sequence: Synthetic peptide
  Seed: ALWGPDPAA (INS_HUMAN)
ALWGPDPAL

SEQ ID NO: 34901 - protein, 10 aa, Artificial Sequence
  Description of Artificial Sequence: Synthetic peptide
  Seed: WMRLLPLLAL (INS_HUMAN)
WERLLPLLAI

SEQ ID NO: 34902 - protein, 9 aa, Artificial Sequence
  Description of Artificial Sequence: Synthetic peptide
  Seed: AAFVNQHLC (INS_HUMAN)
AAFVNQHLL

SEQ ID NO: 34903 - protein, 9 aa, Artificial Sequence
  Description of Artificial Sequence: Synthetic peptide
  Seed: HLVEALYLV (INS_HUMAN)
HIVEALYLK

SEQ ID NO: 34904 - protein, 10 aa, Artificial Sequence
  Description of Artificial Sequence: Synthetic peptide
  Seed: WGPDPAAAFV (INS_HUMAN)
WAPDPAAAFM

SEQ ID NO: 34905 - protein, 10 aa, Artificial Sequence
  Description of Artificial Sequence: Synthetic peptide
  Seed: RGFFYTPKTR (INS_HUMAN)
RSFFYTPKTR

SEQ ID NO: 34906 - protein, 9 aa, Artificial Sequence
  Description of Artificial Sequence: Synthetic peptide
  Seed: YTPKTRREA (INS_HUMAN)
YQPKTRREL

SEQ ID NO: 34907 - protein, 9 aa, Artificial Sequence
  Description of Artificial Sequence: Synthetic peptide
  Seed: LPLLALLAL (INS_HUMAN)
LPLLALLAI

SEQ ID NO: 34908 - protein, 10 aa, Artificial Sequence
  Description of Artificial Sequence: Synthetic peptide
  Seed: AEDLQVGQVE (INS_HUMAN)
AEDLQVGQVV

SEQ ID NO: 34909 - protein, 9 aa, Artificial Sequence
  Description of Artificial Sequence: Synthetic peptide
  Seed: LVCGERGFF (INS_HUMAN)
LSCGERGFW

SEQ ID NO: 34910 - protein, 10 aa, Artificial Sequence
  Description of Artificial Sequence: Synthetic peptide
  Seed: HLVEALYLVC (INS_HUMAN)
HQVEALYLVI

SEQ ID NO: 34911 - protein, 10 aa, Artificial Sequence
  Description of Artificial Sequence: Synthetic peptide
  Seed: WMRLLPLLAL (INS_HUMAN)
WDRLLPLLAL

SEQ ID NO: 34912 - protein, 9 aa, Artificial Sequence
  Description of Artificial Sequence: Synthetic peptide
  Seed: AAFVNQHLC (INS_HUMAN)
AAFVNQHLM

SEQ ID NO: 34913 - protein, 9 aa, Artificial Sequence
  Description of Artificial Sequence: Synthetic peptide
  Seed: RLLPLLALL (INS_HUMAN)
RHLPLLALY

SEQ ID NO: 34914 - protein, 9 aa, Artificial Sequence
  Description of Artificial Sequence: Synthetic peptide
  Seed: YTPKTRREA (INS_HUMAN)
YLPKTRREM

SEQ ID NO: 34915 - protein, 11 aa, Artificial Sequence
  Description of Artificial Sequence: Synthetic peptide
  Seed: HLCGSHLVEAL (INS_HUMAN)
HQCGSHLVEAL

SEQ ID NO: 34916 - protein, 10 aa, Artificial Sequence
  Description of Artificial Sequence: Synthetic peptide
  Seed: WMRLLPLLAL (INS_HUMAN)
WPRLLPLLAV

SEQ ID NO: 34917 - protein, 11 aa, Artificial Sequence
  Description of Artificial Sequence: Synthetic peptide
  Seed: MALWMRLLPLL (INS_HUMAN)
MLLWMRLLPLI

SEQ ID NO: 34918 - protein, 11 aa, Artificial Sequence
  Description of Artificial Sequence: Synthetic peptide
  Seed: MALWMRLLPLL (INS_HUMAN)
MYLWMRLLPLV

SEQ ID NO: 34919 - protein, 10 aa, Artificial Sequence
  Description of Artificial Sequence: Synthetic peptide
  Seed: MALWMRLLPL (INS_HUMAN)
MSLWMRLLPF

SEQ ID NO: 34920 - protein, 10 aa, Artificial Sequence
  Description of Artificial Sequence: Synthetic peptide
  Seed: HLVEALYLVC (INS_HUMAN)
HMVEALYLVP

SEQ ID NO: 34921 - protein, 11 aa, Artificial Sequence
  Description of Artificial Sequence: Synthetic peptide
  Seed: LWMRLLPLLAL (INS_HUMAN)
LYMRLLPLLAI

SEQ ID NO: 34922 - protein, 11 aa, Artificial Sequence
  Description of Artificial Sequence: Synthetic peptide
  Seed: WMRLLPLLALL (INS_HUMAN)
WWRLLPLLALL

SEQ ID NO: 34923 - protein, 10 aa, Artificial Sequence
  Description of Artificial Sequence: Synthetic peptide
  Seed: LGGGPGAGSL (INS_HUMAN)
LAGGPGAGSL

SEQ ID NO: 34924 - protein, 10 aa, Artificial Sequence
  Description of Artificial Sequence: Synthetic peptide
  Seed: RGFFYTPKTR (INS_HUMAN)
RSFFYTPKTA

SEQ ID NO: 34925 - protein, 9 aa, Artificial Sequence
  Description of Artificial Sequence: Synthetic peptide
  Seed: AAAFVNQHL (INS_HUMAN)
ALAFVNQHA

SEQ ID NO: 34926 - protein, 9 aa, Artificial Sequence
  Description of Artificial Sequence: Synthetic peptide
  Seed: TSICSLYQL (INS_HUMAN)
TTICSLYQV

SEQ ID NO: 34927 - protein, 10 aa, Artificial Sequence
  Description of Artificial Sequence: Synthetic peptide
  Seed: MRLLPLLALL (INS_HUMAN)
MHLLPLLALA

SEQ ID NO: 34928 - protein, 9 aa, Artificial Sequence
  Description of Artificial Sequence: Synthetic peptide
  Seed: LALWGPDPA (INS_HUMAN)
LPLWGPDPL

SEQ ID NO: 34929 - protein, 11 aa, Artificial Sequence
  Description of Artificial Sequence: Synthetic peptide
  Seed: WMRLLPLLALL (INS_HUMAN)
WGRLLPLLALV

SEQ ID NO: 34930 - protein, 8 aa, Artificial Sequence
  Description of Artificial Sequence: Synthetic peptide
  Seed: RLLPLLAL (INS_HUMAN)
RQLPLLAV

SEQ ID NO: 34931 - protein, 9 aa, Artificial Sequence
  Description of Artificial Sequence: Synthetic peptide
  Seed: AEDLQVGQV (INS_HUMAN)
ASDLQVGQV

SEQ ID NO: 34932 - protein, 10 aa, Artificial Sequence
  Description of Artificial Sequence: Synthetic peptide
  Seed: RLLPLLALLA (INS_HUMAN)
RLLPLLALLW

SEQ ID NO: 34933 - protein, 10 aa, Artificial Sequence
  Description of Artificial Sequence: Synthetic peptide
  Seed: MRLLPLLALL (INS_HUMAN)
MRLLPLLALM

SEQ ID NO: 34934 - protein, 11 aa, Artificial Sequence
  Description of Artificial Sequence: Synthetic peptide
  Seed: ALWGPDPAAAF (INS_HUMAN)
AFWGPDPAAAF

SEQ ID NO: 34935 - protein, 10 aa, Artificial Sequence
  Description of Artificial Sequence: Synthetic peptide
  Seed: LALWGPDPAA (INS_HUMAN)
LLLWGPDPAI

SEQ ID NO: 34936 - protein, 9 aa, Artificial Sequence
  Description of Artificial Sequence: Synthetic peptide
  Seed: ALWMRLLPL (INS_HUMAN)
AHWMRLLPF

SEQ ID NO: 34937 - protein, 9 aa, Artificial Sequence
  Description of Artificial Sequence: Synthetic peptide
  Seed: ALWMRLLPL (INS_HUMAN)
APWMRLLPM

SEQ ID NO: 34938 - protein, 9 aa, Artificial Sequence
  Description of Artificial Sequence: Synthetic peptide
  Seed: LWMRLLPLL (INS_HUMAN)
LFMRLLPLF

SEQ ID NO: 34939 - protein, 10 aa, Artificial Sequence
  Description of Artificial Sequence: Synthetic peptide
  Seed: MALWMRLLPL (INS_HUMAN)
MMLWMRLLPW

SEQ ID NO: 34940 - protein, 9 aa, Artificial Sequence
  Description of Artificial Sequence: Synthetic peptide
  Seed: ALWMRLLPL (INS_HUMAN)
APWMRLLPT

SEQ ID NO: 34941 - protein, 8 aa, Artificial Sequence
  Description of Artificial Sequence: Synthetic peptide
  Seed: HLVEALYL (INS_HUMAN)
HLVEALYV

SEQ ID NO: 34942 - protein, 9 aa, Artificial Sequence
  Description of Artificial Sequence: Synthetic peptide
  Seed: ALWMRLLPL (INS_HUMAN)
ALWMRLLPF

SEQ ID NO: 34943 - protein, 11 aa, Artificial Sequence
  Description of Artificial Sequence: Synthetic peptide
  Seed: KTRREAEDLQV (INS_HUMAN)
KTRREAEDLQW

SEQ ID NO: 34944 - protein, 11 aa, Artificial Sequence
  Description of Artificial Sequence: Synthetic peptide
  Seed: SHLVEALYLVC (INS_HUMAN)
SLLVEALYLVQ

SEQ ID NO: 34945 - protein, 9 aa, Artificial Sequence
  Description of Artificial Sequence: Synthetic peptide
  Seed: AGSLQPLAL (INS_HUMAN)
ATSLQPLAV

SEQ ID NO: 34946 - protein, 9 aa, Artificial Sequence
  Description of Artificial Sequence: Synthetic peptide
  Seed: MRLLPLLAL (INS_HUMAN)
MQLLPLLAV

SEQ ID NO: 34947 - protein, 9 aa, Artificial Sequence
  Description of Artificial Sequence: Synthetic peptide
  Seed: YLVCGERGF (INS_HUMAN)
YAVCGERGY

SEQ ID NO: 34948 - protein, 9 aa, Artificial Sequence
  Description of Artificial Sequence: Synthetic peptide
  Seed: KTRREAEDL (INS_HUMAN)
KTRREAEDW

SEQ ID NO: 34949 - protein, 9 aa, Artificial Sequence
  Description of Artificial Sequence: Synthetic peptide
  Seed: HLVEALYLV (INS_HUMAN)
HTVEALYLV

SEQ ID NO: 34950 - protein, 9 aa, Artificial Sequence
  Description of Artificial Sequence: Synthetic peptide
  Seed: TSICSLYQL (INS_HUMAN)
TQICSLYQF

SEQ ID NO: 34951 - protein, 10 aa, Artificial Sequence
  Description of Artificial Sequence: Synthetic peptide
  Seed: WMRLLPLLAL (INS_HUMAN)
WNRLLPLLAL

SEQ ID NO: 34952 - protein, 9 aa, Artificial Sequence
  Description of Artificial Sequence: Synthetic peptide
  Seed: LPLLALLAL (INS_HUMAN)
LSLLALLAY

SEQ ID NO: 34953 - protein, 10 aa, Artificial Sequence
  Description of Artificial Sequence: Synthetic peptide
  Seed: MALWMRLLPL (INS_HUMAN)
MVLWMRLLPL

SEQ ID NO: 34954 - protein, 10 aa, Artificial Sequence
  Description of Artificial Sequence: Synthetic peptide
  Seed: SHLVEALYLV (INS_HUMAN)
SHLVEALYLI

SEQ ID NO: 34955 - protein, 9 aa, Artificial Sequence
  Description of Artificial Sequence: Synthetic peptide
  Seed: VCGERGFFY (INS_HUMAN)
VAGERGFFF

SEQ ID NO: 34956 - protein, 9 aa, Artificial Sequence
  Description of Artificial Sequence: Synthetic peptide
  Seed: AAAFVNQHL (INS_HUMAN)
AVAFVNQHW

SEQ ID NO: 34957 - protein, 10 aa, Artificial Sequence
  Description of Artificial Sequence: Synthetic peptide
  Seed: MALWMRLLPL (INS_HUMAN)
MELWMRLLPI

SEQ ID NO: 34958 - protein, 10 aa, Artificial Sequence
  Description of Artificial Sequence: Synthetic peptide
  Seed: MALWMRLLPL (INS_HUMAN)
MVLWMRLLPY

SEQ ID NO: 34959 - protein, 11 aa, Artificial Sequence
  Description of Artificial Sequence: Synthetic peptide
  Seed: MALWMRLLPLL (INS_HUMAN)
MYLWMRLLPLM

SEQ ID NO: 34960 - protein, 10 aa, Artificial Sequence
  Description of Artificial Sequence: Synthetic peptide
  Seed: MRLLPLLALL (INS_HUMAN)
MMLLPLLALA

SEQ ID NO: 34961 - protein, 9 aa, Artificial Sequence
  Description of Artificial Sequence: Synthetic peptide
  Seed: DLQVGQVEL (INS_HUMAN)
DQQVGQVEY

SEQ ID NO: 34962 - protein, 10 aa, Artificial Sequence
  Description of Artificial Sequence: Synthetic peptide
  Seed: LVCGERGFFY (INS_HUMAN)
LTCGERGFFW

SEQ ID NO: 34963 - protein, 9 aa, Artificial Sequence
  Description of Artificial Sequence: Synthetic peptide
  Seed: LWMRLLPLL (INS_HUMAN)
LQMRLLPLF

SEQ ID NO: 34964 - protein, 9 aa, Artificial Sequence
  Description of Artificial Sequence: Synthetic peptide
  Seed: LLPLLALLA (INS_HUMAN)
LMPLLALLI

SEQ ID NO: 34965 - protein, 10 aa, Artificial Sequence
  Description of Artificial Sequence: Synthetic peptide
  Seed: MALWMRLLPL (INS_HUMAN)
MWLWMRLLPY

SEQ ID NO: 34966 - protein, 10 aa, Artificial Sequence
  Description of Artificial Sequence: Synthetic peptide
  Seed: MRLLPLLALL (INS_HUMAN)
MCLLPLLALL

SEQ ID NO: 34967 - protein, 11 aa, Artificial Sequence
  Description of Artificial Sequence: Synthetic peptide
  Seed: MALWMRLLPLL (INS_HUMAN)
MGLWMRLLPLF

SEQ ID NO: 34968 - protein, 9 aa, Artificial Sequence
  Description of Artificial Sequence: Synthetic peptide
  Seed: ALWMRLLPL (INS_HUMAN)
ASWMRLLPY

SEQ ID NO: 34969 - protein, 9 aa, Artificial Sequence
  Description of Artificial Sequence: Synthetic peptide
  Seed: LALWGPDPA (INS_HUMAN)
LALWGPDPL

SEQ ID NO: 34970 - protein, 9 aa, Artificial Sequence
  Description of Artificial Sequence: Synthetic peptide
  Seed: AAAFVNQHL (INS_HUMAN)
AIAFVNQHW

SEQ ID NO: 34971 - protein, 9 aa, Artificial Sequence
  Description of Artificial Sequence: Synthetic peptide
  Seed: AGSLQPLAL (INS_HUMAN)
ARSLQPLAF

SEQ ID NO: 34972 - protein, 9 aa, Artificial Sequence
  Description of Artificial Sequence: Synthetic peptide
  Seed: WGPDPAAAF (INS_HUMAN)
WYPDPAAAL

SEQ ID NO: 34973 - protein, 10 aa, Artificial Sequence
  Description of Artificial Sequence: Synthetic peptide
  Seed: WMRLLPLLAL (INS_HUMAN)
WHRLLPLLAL

SEQ ID NO: 34974 - protein, 11 aa, Artificial Sequence
  Description of Artificial Sequence: Synthetic peptide
  Seed: WMRLLPLLALL (INS_HUMAN)
WIRLLPLLALL

SEQ ID NO: 34975 - protein, 10 aa, Artificial Sequence
  Description of Artificial Sequence: Synthetic peptide
  Seed: MALWMRLLPL (INS_HUMAN)
MVLWMRLLPM

SEQ ID NO: 34976 - protein, 11 aa, Artificial Sequence
  Description of Artificial Sequence: Synthetic peptide
  Seed: WMRLLPLLALL (INS_HUMAN)
WWRLLPLLALV

SEQ ID NO: 34977 - protein, 10 aa, Artificial Sequence
  Description of Artificial Sequence: Synthetic peptide
  Seed: REAEDLQVGQ (INS_HUMAN)
REAEDLQVGL

SEQ ID NO: 34978 - protein, 9 aa, Artificial Sequence
  Description of Artificial Sequence: Synthetic peptide
  Seed: AEDLQVGQV (INS_HUMAN)
AVDLQVGQV

SEQ ID NO: 34979 - protein, 10 aa, Artificial Sequence
  Description of Artificial Sequence: Synthetic peptide
  Seed: EALYLVCGER (INS_HUMAN)
EILYLVCGER

SEQ ID NO: 34980 - protein, 9 aa, Artificial Sequence
  Description of Artificial Sequence: Synthetic peptide
  Seed: FVNQHLCGS (INS_HUMAN)
FVNQHLCGA

SEQ ID NO: 34981 - protein, 10 aa, Artificial Sequence
  Description of Artificial Sequence: Synthetic peptide
  Seed: SHLVEALYLV (INS_HUMAN)
SFLVEALYLT

SEQ ID NO: 34982 - protein, 9 aa, Artificial Sequence
  Description of Artificial Sequence: Synthetic peptide
  Seed: WGPDPAAAF (INS_HUMAN)
WAPDPAAAI

SEQ ID NO: 34983 - protein, 9 aa, Artificial Sequence
  Description of Artificial Sequence: Synthetic peptide
  Seed: HLVEALYLV (INS_HUMAN)
HLVEALYLR

SEQ ID NO: 34984 - protein, 11 aa, Artificial Sequence
  Description of Artificial Sequence: Synthetic peptide
  Seed: GSHLVEALYLV (INS_HUMAN)
GHHLVEALYLV

SEQ ID NO: 34985 - protein, 9 aa, Artificial Sequence
  Description of Artificial Sequence: Synthetic peptide
  Seed: AEDLQVGQV (INS_HUMAN)
ASDLQVGQF

SEQ ID NO: 34986 - protein, 10 aa, Artificial Sequence
  Description of Artificial Sequence: Synthetic peptide
  Seed: MRLLPLLALL (INS_HUMAN)
MNLLPLLALA

SEQ ID NO: 34987 - protein, 9 aa, Artificial Sequence
  Description of Artificial Sequence: Synthetic peptide
  Seed: AGSLQPLAL (INS_HUMAN)
ASSLQPLAF

SEQ ID NO: 34988 - protein, 11 aa, Artificial Sequence
  Description of Artificial Sequence: Synthetic peptide
  Seed: YLVCGERGFFY (INS_HUMAN)
YIVCGERGFFY

SEQ ID NO: 34989 - protein, 10 aa, Artificial Sequence
  Description of Artificial Sequence: Synthetic peptide
  Seed: LWMRLLPLLA (INS_HUMAN)
LLMRLLPLLI

SEQ ID NO: 34990 - protein, 11 aa, Artificial Sequence
  Description of Artificial Sequence: Synthetic peptide
  Seed: GSHLVEALYLV (INS_HUMAN)
GEHLVEALYLI

SEQ ID NO: 34991 - protein, 9 aa, Artificial Sequence
  Description of Artificial Sequence: Synthetic peptide
  Seed: YLVCGERGF (INS_HUMAN)
YKVCGERGY

SEQ ID NO: 34992 - protein, 10 aa, Artificial Sequence
  Description of Artificial Sequence: Synthetic peptide
  Seed: MALWMRLLPL (INS_HUMAN)
MHLWMRLLPV

SEQ ID NO: 34993 - protein, 10 aa, Artificial Sequence
  Description of Artificial Sequence: Synthetic peptide
  Seed: RLLPLLALLA (INS_HUMAN)
RVLPLLALLL

SEQ ID NO: 34994 - protein, 9 aa, Artificial Sequence
  Description of Artificial Sequence: Synthetic peptide
  Seed: VCGERGFFY (INS_HUMAN)
VAGERGFFL

SEQ ID NO: 34995 - protein, 10 aa, Artificial Sequence
  Description of Artificial Sequence: Synthetic peptide
  Seed: SHLVEALYLV (INS_HUMAN)
SFLVEALYLL

SEQ ID NO: 34996 - protein, 10 aa, Artificial Sequence
  Description of Artificial Sequence: Synthetic peptide
  Seed: SHLVEALYLV (INS_HUMAN)
SHLVEALYLL

SEQ ID NO: 34997 - protein, 9 aa, Artificial Sequence
  Description of Artificial Sequence: Synthetic peptide
  Seed: YTPKTRREA (INS_HUMAN)
YMPKTRREL

SEQ ID NO: 34998 - protein, 10 aa, Artificial Sequence
  Description of Artificial Sequence: Synthetic peptide
  Seed: MRLLPLLALL (INS_HUMAN)
MFLLPLLALV

SEQ ID NO: 34999 - protein, 9 aa, Artificial Sequence
  Description of Artificial Sequence: Synthetic peptide
  Seed: AAFVNQHLC (INS_HUMAN)
AAFVNQHLF

SEQ ID NO: 35000 - protein, 10 aa, Artificial Sequence
  Description of Artificial Sequence: Synthetic peptide
  Seed: VNQHLCGSHL (INS_HUMAN)
VIQHLCGSHF

SEQ ID NO: 35001 - protein, 9 aa, Artificial Sequence
  Description of Artificial Sequence: Synthetic peptide
  Seed: ALWMRLLPL (INS_HUMAN)
AEWMRLLPY

SEQ ID NO: 35002 - protein, 10 aa, Artificial Sequence
  Description of Artificial Sequence: Synthetic peptide
  Seed: WMRLLPLLAL (INS_HUMAN)
WARLLPLLAK

SEQ ID NO: 35003 - protein, 9 aa, Artificial Sequence
  Description of Artificial Sequence: Synthetic peptide
  Seed: WGPDPAAAF (INS_HUMAN)
WFPDPAAAF

SEQ ID NO: 35004 - protein, 10 aa, Artificial Sequence
  Description of Artificial Sequence: Synthetic peptide
  Seed: MRLLPLLALL (INS_HUMAN)
MWLLPLLALA

SEQ ID NO: 35005 - protein, 10 aa, Artificial Sequence
  Description of Artificial Sequence: Synthetic peptide
  Seed: ALWMRLLPLL (INS_HUMAN)
AWWMRLLPLW

SEQ ID NO: 35006 - protein, 9 aa, Artificial Sequence
  Description of Artificial Sequence: Synthetic peptide
  Seed: RLLPLLALL (INS_HUMAN)
RGLPLLALY

SEQ ID NO: 35007 - protein, 10 aa, Artificial Sequence
  Description of Artificial Sequence: Synthetic peptide
  Seed: LLPLLALLAL (INS_HUMAN)
LEPLLALLAY

SEQ ID NO: 35008 - protein, 10 aa, Artificial Sequence
  Description of Artificial Sequence: Synthetic peptide
  Seed: SHLVEALYLV (INS_HUMAN)
SMLVEALYLT

SEQ ID NO: 35009 - protein, 9 aa, Artificial Sequence
  Description of Artificial Sequence: Synthetic peptide
  Seed: IVEQCCTSI (INS_HUMAN)
IAEQCCTSL

SEQ ID NO: 35010 - protein, 9 aa, Artificial Sequence
  Description of Artificial Sequence: Synthetic peptide
  Seed: MRLLPLLAL (INS_HUMAN)
MALLPLLAY

SEQ ID NO: 35011 - protein, 10 aa, Artificial Sequence
  Description of Artificial Sequence: Synthetic peptide
  Seed: LALWGPDPAA (INS_HUMAN)
LPLWGPDPAL

SEQ ID NO: 35012 - protein, 8 aa, Artificial Sequence
  Description of Artificial Sequence: Synthetic peptide
  Seed: RGFFYTPK (INS_HUMAN)
RYFFYTPR

SEQ ID NO: 35013 - protein, 9 aa, Artificial Sequence
  Description of Artificial Sequence: Synthetic peptide
  Seed: CCTSICSLY (INS_HUMAN)
CLTSICSLY

SEQ ID NO: 35014 - protein, 10 aa, Artificial Sequence
  Description of Artificial Sequence: Synthetic peptide
  Seed: LLALWGPDPA (INS_HUMAN)
LIALWGPDPV

SEQ ID NO: 35015 - protein, 9 aa, Artificial Sequence
  Description of Artificial Sequence: Synthetic peptide
  Seed: WGPDPAAAF (INS_HUMAN)
WTPDPAAAI

SEQ ID NO: 35016 - protein, 11 aa, Artificial Sequence
  Description of Artificial Sequence: Synthetic peptide
  Seed: GSHLVEALYLV (INS_HUMAN)
GAHLVEALYLI

SEQ ID NO: 35017 - protein, 9 aa, Artificial Sequence
  Description of Artificial Sequence: Synthetic peptide
  Seed: YTPKTRREA (INS_HUMAN)
YAPKTRREF

SEQ ID NO: 35018 - protein, 11 aa, Artificial Sequence
  Description of Artificial Sequence: Synthetic peptide
  Seed: GSHLVEALYLV (INS_HUMAN)
GFHLVEALYLL

SEQ ID NO: 35019 - protein, 10 aa, Artificial Sequence
  Description of Artificial Sequence: Synthetic peptide
  Seed: MALWMRLLPL (INS_HUMAN)
MNLWMRLLPV

SEQ ID NO: 35020 - protein, 10 aa, Artificial Sequence
  Description of Artificial Sequence: Synthetic peptide
  Seed: MALWMRLLPL (INS_HUMAN)
MPLWMRLLPL

SEQ ID NO: 35021 - protein, 9 aa, Artificial Sequence
  Description of Artificial Sequence: Synthetic peptide
  Seed: RLLPLLALL (INS_HUMAN)
RILPLLALV

SEQ ID NO: 35022 - protein, 10 aa, Artificial Sequence
  Description of Artificial Sequence: Synthetic peptide
  Seed: ALWGPDPAAA (INS_HUMAN)
AQWGPDPAAI

SEQ ID NO: 35023 - protein, 9 aa, Artificial Sequence
  Description of Artificial Sequence: Synthetic peptide
  Seed: AGSLQPLAL (INS_HUMAN)
AYSLQPLAY

SEQ ID NO: 35024 - protein, 8 aa, Artificial Sequence
  Description of Artificial Sequence: Synthetic peptide
  Seed: LVEALYLV (INS_HUMAN)
LIEALYLV

SEQ ID NO: 35025 - protein, 10 aa, Artificial Sequence
  Description of Artificial Sequence: Synthetic peptide
  Seed: WMRLLPLLAL (INS_HUMAN)
WIRLLPLLAI

SEQ ID NO: 35026 - protein, 11 aa, Artificial Sequence
  Description of Artificial Sequence: Synthetic peptide
  Seed: RGFFYTPKTRR (INS_HUMAN)
RTFFYTPKTRR

SEQ ID NO: 35027 - protein, 10 aa, Artificial Sequence
  Description of Artificial Sequence: Synthetic peptide
  Seed: MRLLPLLALL (INS_HUMAN)
MRLLPLLALV

SEQ ID NO: 35028 - protein, 9 aa, Artificial Sequence
  Description of Artificial Sequence: Synthetic peptide
  Seed: RLLPLLALL (INS_HUMAN)
RLLPLLALM

SEQ ID NO: 35029 - protein, 9 aa, Artificial Sequence
  Description of Artificial Sequence: Synthetic peptide
  Seed: ALWMRLLPL (INS_HUMAN)
ASWMRLLPW

SEQ ID NO: 35030 - protein, 9 aa, Artificial Sequence
  Description of Artificial Sequence: Synthetic peptide
  Seed: RLLPLLALL (INS_HUMAN)
RWLPLLALY

SEQ ID NO: 35031 - protein, 10 aa, Artificial Sequence
  Description of Artificial Sequence: Synthetic peptide
  Seed: ALWGPDPAAA (INS_HUMAN)
ALWGPDPAAM

SEQ ID NO: 35032 - protein, 11 aa, Artificial Sequence
  Description of Artificial Sequence: Synthetic peptide
  Seed: SHLVEALYLVC (INS_HUMAN)
SYLVEALYLVA

SEQ ID NO: 35033 - protein, 9 aa, Artificial Sequence
  Description of Artificial Sequence: Synthetic peptide
  Seed: WGPDPAAAF (INS_HUMAN)
WVPDPAAAL

SEQ ID NO: 35034 - protein, 11 aa, Artificial Sequence
  Description of Artificial Sequence: Synthetic peptide
  Seed: ALWMRLLPLLA (INS_HUMAN)
AMWMRLLPLLV

SEQ ID NO: 35035 - protein, 10 aa, Artificial Sequence
  Description of Artificial Sequence: Synthetic peptide
  Seed: MRLLPLLALL (INS_HUMAN)
MPLLPLLALI

SEQ ID NO: 35036 - protein, 9 aa, Artificial Sequence
  Description of Artificial Sequence: Synthetic peptide
  Seed: TSICSLYQL (INS_HUMAN)
TSICSLYQI

SEQ ID NO: 35037 - protein, 9 aa, Artificial Sequence
  Description of Artificial Sequence: Synthetic peptide
  Seed: GPDPAAAFV (INS_HUMAN)
GFDPAAAFF

SEQ ID NO: 35038 - protein, 10 aa, Artificial Sequence
  Description of Artificial Sequence: Synthetic peptide
  Seed: SHLVEALYLV (INS_HUMAN)
SLLVEALYLM

SEQ ID NO: 35039 - protein, 11 aa, Artificial Sequence
  Description of Artificial Sequence: Synthetic peptide
  Seed: WMRLLPLLALL (INS_HUMAN)
WDRLLPLLALL

SEQ ID NO: 35040 - protein, 10 aa, Artificial Sequence
  Description of Artificial Sequence: Synthetic peptide
  Seed: LALWGPDPAA (INS_HUMAN)
LTLWGPDPAV

SEQ ID NO: 35041 - protein, 9 aa, Artificial Sequence
  Description of Artificial Sequence: Synthetic peptide
  Seed: HLVEALYLV (INS_HUMAN)
HLVEALYLA

SEQ ID NO: 35042 - protein, 10 aa, Artificial Sequence
  Description of Artificial Sequence: Synthetic peptide
  Seed: MRLLPLLALL (INS_HUMAN)
MNLLPLLALL

SEQ ID NO: 35043 - protein, 10 aa, Artificial Sequence
  Description of Artificial Sequence: Synthetic peptide
  Seed: MALWMRLLPL (INS_HUMAN)
MKLWMRLLPF

SEQ ID NO: 35044 - protein, 10 aa, Artificial Sequence
  Description of Artificial Sequence: Synthetic peptide
  Seed: MRLLPLLALL (INS_HUMAN)
MSLLPLLALA

SEQ ID NO: 35045 - protein, 9 aa, Artificial Sequence
  Description of Artificial Sequence: Synthetic peptide
  Seed: AAAFVNQHL (INS_HUMAN)
ATAFVNQHV

SEQ ID NO: 35046 - protein, 10 aa, Artificial Sequence
  Description of Artificial Sequence: Synthetic peptide
  Seed: MALWMRLLPL (INS_HUMAN)
MCLWMRLLPM

SEQ ID NO: 35047 - protein, 9 aa, Artificial Sequence
  Description of Artificial Sequence: Synthetic peptide
  Seed: FVNQHLCGS (INS_HUMAN)
FANQHLCGA

SEQ ID NO: 35048 - protein, 10 aa, Artificial Sequence
  Description of Artificial Sequence: Synthetic peptide
  Seed: HLVEALYLVC (INS_HUMAN)
HMVEALYLVT

SEQ ID NO: 35049 - protein, 11 aa, Artificial Sequence
  Description of Artificial Sequence: Synthetic peptide
  Seed: ALWGPDPAAAF (INS_HUMAN)
ATWGPDPAAAF

SEQ ID NO: 35050 - protein, 10 aa, Artificial Sequence
  Description of Artificial Sequence: Synthetic peptide
  Seed: CGSHLVEALY (INS_HUMAN)
CYSHLVEALY

SEQ ID NO: 35051 - protein, 9 aa, Artificial Sequence
  Description of Artificial Sequence: Synthetic peptide
  Seed: GPDPAAAFV (INS_HUMAN)
GGDPAAAFM

SEQ ID NO: 35052 - protein, 11 aa, Artificial Sequence
  Description of Artificial Sequence: Synthetic peptide
  Seed: SHLVEALYLVC (INS_HUMAN)
SMLVEALYLVQ

SEQ ID NO: 35053 - protein, 10 aa, Artificial Sequence
  Description of Artificial Sequence: Synthetic peptide
  Seed: LALWGPDPAA (INS_HUMAN)
LDLWGPDPAV

SEQ ID NO: 35054 - protein, 9 aa, Artificial Sequence
  Description of Artificial Sequence: Synthetic peptide
  Seed: SLYQLENYC (INS_HUMAN)
SLYQLENYA

SEQ ID NO: 35055 - protein, 9 aa, Artificial Sequence
  Description of Artificial Sequence: Synthetic peptide
  Seed: AEDLQVGQV (INS_HUMAN)
AADLQVGQV

SEQ ID NO: 35056 - protein, 9 aa, Artificial Sequence
  Description of Artificial Sequence: Synthetic peptide
  Seed: AGSLQPLAL (INS_HUMAN)
AQSLQPLAM

SEQ ID NO: 35057 - protein, 9 aa, Artificial Sequence
  Description of Artificial Sequence: Synthetic peptide
  Seed: WGPDPAAAF (INS_HUMAN)
WGPDPAAAM

SEQ ID NO: 35058 - protein, 9 aa, Artificial Sequence
  Description of Artificial Sequence: Synthetic peptide
  Seed: AAFVNQHLC (INS_HUMAN)
ATFVNQHLL

SEQ ID NO: 35059 - protein, 9 aa, Artificial Sequence
  Description of Artificial Sequence: Synthetic peptide
  Seed: AGSLQPLAL (INS_HUMAN)
AQSLQPLAL

SEQ ID NO: 35060 - protein, 9 aa, Artificial Sequence
  Description of Artificial Sequence: Synthetic peptide
  Seed: GSHLVEALY (INS_HUMAN)
GVHLVEALY

SEQ ID NO: 35061 - protein, 10 aa, Artificial Sequence
  Description of Artificial Sequence: Synthetic peptide
  Seed: MALWMRLLPL (INS_HUMAN)
MYLWMRLLPY

SEQ ID NO: 35062 - protein, 9 aa, Artificial Sequence
  Description of Artificial Sequence: Synthetic peptide
  Seed: LALEGSLQK (INS_HUMAN)
LLLEGSLQR

SEQ ID NO: 35063 - protein, 9 aa, Artificial Sequence
  Description of Artificial Sequence: Synthetic peptide
  Seed: TSICSLYQL (INS_HUMAN)
TSICSLYQM

SEQ ID NO: 35064 - protein, 10 aa, Artificial Sequence
  Description of Artificial Sequence: Synthetic peptide
  Seed: LLPLLALLAL (INS_HUMAN)
LSPLLALLAL

SEQ ID NO: 35065 - protein, 9 aa, Artificial Sequence
  Description of Artificial Sequence: Synthetic peptide
  Seed: MRLLPLLAL (INS_HUMAN)
MQLLPLLAH

SEQ ID NO: 35066 - protein, 10 aa, Artificial Sequence
  Description of Artificial Sequence: Synthetic peptide
  Seed: YLVCGERGFF (INS_HUMAN)
YQVCGERGFF

SEQ ID NO: 35067 - protein, 10 aa, Artificial Sequence
  Description of Artificial Sequence: Synthetic peptide
  Seed: MALWMRLLPL (INS_HUMAN)
MSLWMRLLPY

SEQ ID NO: 35068 - protein, 10 aa, Artificial Sequence
  Description of Artificial Sequence: Synthetic peptide
  Seed: HLCGSHLVEA (INS_HUMAN)
HLCGSHLVEV

SEQ ID NO: 35069 - protein, 10 aa, Artificial Sequence
  Description of Artificial Sequence: Synthetic peptide
  Seed: SHLVEALYLV (INS_HUMAN)
SCLVEALYLM

SEQ ID NO: 35070 - protein, 10 aa, Artificial Sequence
  Description of Artificial Sequence: Synthetic peptide
  Seed: LALWGPDPAA (INS_HUMAN)
LLLWGPDPAL

SEQ ID NO: 35071 - protein, 10 aa, Artificial Sequence
  Description of Artificial Sequence: Synthetic peptide
  Seed: WGPDPAAAFV (INS_HUMAN)
WKPDPAAAFL

SEQ ID NO: 35072 - protein, 11 aa, Artificial Sequence
  Description of Artificial Sequence: Synthetic peptide
  Seed: ALWGPDPAAAF (INS_HUMAN)
ASWGPDPAAAL

SEQ ID NO: 35073 - protein, 10 aa, Artificial Sequence
  Description of Artificial Sequence: Synthetic peptide
  Seed: ALWGPDPAAA (INS_HUMAN)
AMWGPDPAAR

SEQ ID NO: 35074 - protein, 9 aa, Artificial Sequence
  Description of Artificial Sequence: Synthetic peptide
  Seed: RLLPLLALL (INS_HUMAN)
RKLPLLALF

SEQ ID NO: 35075 - protein, 10 aa, Artificial Sequence
  Description of Artificial Sequence: Synthetic peptide
  Seed: ALWMRLLPLL (INS_HUMAN)
AVWMRLLPLV

SEQ ID NO: 35076 - protein, 10 aa, Artificial Sequence
  Description of Artificial Sequence: Synthetic peptide
  Seed: LLALWGPDPA (INS_HUMAN)
LLALWGPDPI

SEQ ID NO: 35077 - protein, 9 aa, Artificial Sequence
  Description of Artificial Sequence: Synthetic peptide
  Seed: YTPKTRREA (INS_HUMAN)
YIPKTRREY

SEQ ID NO: 35078 - protein, 10 aa, Artificial Sequence
  Description of Artificial Sequence: Synthetic peptide
  Seed: ALWGPDPAAA (INS_HUMAN)
AIWGPDPAAR

SEQ ID NO: 35079 - protein, 10 aa, Artificial Sequence
  Description of Artificial Sequence: Synthetic peptide
  Seed: LWGPDPAAAF (INS_HUMAN)
LIGPDPAAAY

SEQ ID NO: 35080 - protein, 9 aa, Artificial Sequence
  Description of Artificial Sequence: Synthetic peptide
  Seed: GFFYTPKTR (INS_HUMAN)
GMFYTPKTR

SEQ ID NO: 35081 - protein, 10 aa, Artificial Sequence
  Description of Artificial Sequence: Synthetic peptide
  Seed: MALWMRLLPL (INS_HUMAN)
MTLWMRLLPL

SEQ ID NO: 35082 - protein, 9 aa, Artificial Sequence
  Description of Artificial Sequence: Synthetic peptide
  Seed: MRLLPLLAL (INS_HUMAN)
MILLPLLAY

SEQ ID NO: 35083 - protein, 11 aa, Artificial Sequence
  Description of Artificial Sequence: Synthetic peptide
  Seed: SHLVEALYLVC (INS_HUMAN)
SFLVEALYLVA

SEQ ID NO: 35084 - protein, 10 aa, Artificial Sequence
  Description of Artificial Sequence: Synthetic peptide
  Seed: SHLVEALYLV (INS_HUMAN)
SQLVEALYLL

SEQ ID NO: 35085 - protein, 10 aa, Artificial Sequence
  Description of Artificial Sequence: Synthetic peptide
  Seed: MALWMRLLPL (INS_HUMAN)
MHLWMRLLPA

SEQ ID NO: 35086 - protein, 8 aa, Artificial Sequence
  Description of Artificial Sequence: Synthetic peptide
  Seed: RGFFYTPK (INS_HUMAN)
RVFFYTPR

SEQ ID NO: 35087 - protein, 11 aa, Artificial Sequence
  Description of Artificial Sequence: Synthetic peptide
  Seed: GSHLVEALYLV (INS_HUMAN)
GYHLVEALYLV

SEQ ID NO: 35088 - protein, 9 aa, Artificial Sequence
  Description of Artificial Sequence: Synthetic peptide
  Seed: GPDPAAAFV (INS_HUMAN)
GMDPAAAFI

SEQ ID NO: 35089 - protein, 9 aa, Artificial Sequence
  Description of Artificial Sequence: Synthetic peptide
  Seed: TSICSLYQL (INS_HUMAN)
TQICSLYQV

SEQ ID NO: 35090 - protein, 10 aa, Artificial Sequence
  Description of Artificial Sequence: Synthetic peptide
  Seed: MALWMRLLPL (INS_HUMAN)
MVLWMRLLPW

SEQ ID NO: 35091 - protein, 10 aa, Artificial Sequence
  Description of Artificial Sequence: Synthetic peptide
  Seed: MALWMRLLPL (INS_HUMAN)
MHLWMRLLPF

SEQ ID NO: 35092 - protein, 9 aa, Artificial Sequence
  Description of Artificial Sequence: Synthetic peptide
  Seed: FVNQHLCGS (INS_HUMAN)
FTNQHLCGI

SEQ ID NO: 35093 - protein, 11 aa, Artificial Sequence
  Description of Artificial Sequence: Synthetic peptide
  Seed: ALWGPDPAAAF (INS_HUMAN)
AAWGPDPAAAI

SEQ ID NO: 35094 - protein, 9 aa, Artificial Sequence
  Description of Artificial Sequence: Synthetic peptide
  Seed: HLVEALYLV (INS_HUMAN)
HTVEALYLI

SEQ ID NO: 35095 - protein, 11 aa, Artificial Sequence
  Description of Artificial Sequence: Synthetic peptide
  Seed: SHLVEALYLVC (INS_HUMAN)
SMLVEALYLVE

SEQ ID NO: 35096 - protein, 9 aa, Artificial Sequence
  Description of Artificial Sequence: Synthetic peptide
  Seed: SLYQLENYC (INS_HUMAN)
SLYQLENYV

SEQ ID NO: 35097 - protein, 10 aa, Artificial Sequence
  Description of Artificial Sequence: Synthetic peptide
  Seed: HLVEALYLVC (INS_HUMAN)
HMVEALYLVH

SEQ ID NO: 35098 - protein, 10 aa, Artificial Sequence
  Description of Artificial Sequence: Synthetic peptide
  Seed: LALWGPDPAA (INS_HUMAN)
LFLWGPDPAV

SEQ ID NO: 35099 - protein, 11 aa, Artificial Sequence
  Description of Artificial Sequence: Synthetic peptide
  Seed: RGFFYTPKTRR (INS_HUMAN)
RMFFYTPKTRR

SEQ ID NO: 35100 - protein, 10 aa, Artificial Sequence
  Description of Artificial Sequence: Synthetic peptide
  Seed: LLPLLALLAL (INS_HUMAN)
LTPLLALLAY

SEQ ID NO: 35101 - protein, 11 aa, Artificial Sequence
  Description of Artificial Sequence: Synthetic peptide
  Seed: SHLVEALYLVC (INS_HUMAN)
SMLVEALYLVN

SEQ ID NO: 35102 - protein, 10 aa, Artificial Sequence
  Description of Artificial Sequence: Synthetic peptide
  Seed: MRLLPLLALL (INS_HUMAN)
MILLPLLALV

SEQ ID NO: 35103 - protein, 11 aa, Artificial Sequence
  Description of Artificial Sequence: Synthetic peptide
  Seed: ALWGPDPAAAF (INS_HUMAN)
AMWGPDPAAAW

SEQ ID NO: 35104 - protein, 9 aa, Artificial Sequence
  Description of Artificial Sequence: Synthetic peptide
  Seed: FVNQHLCGS (INS_HUMAN)
FMNQHLCGM

SEQ ID NO: 35105 - protein, 11 aa, Artificial Sequence
  Description of Artificial Sequence: Synthetic peptide
  Seed: ALWGPDPAAAF (INS_HUMAN)
AQWGPDPAAAF

SEQ ID NO: 35106 - protein, 11 aa, Artificial Sequence
  Description of Artificial Sequence: Synthetic peptide
  Seed: ALWGPDPAAAF (INS_HUMAN)
AVWGPDPAAAY

SEQ ID NO: 35107 - protein, 11 aa, Artificial Sequence
  Description of Artificial Sequence: Synthetic peptide
  Seed: REAEDLQVGQV (INS_HUMAN)
RIAEDLQVGQL

SEQ ID NO: 35108 - protein, 9 aa, Artificial Sequence
  Description of Artificial Sequence: Synthetic peptide
  Seed: ALWMRLLPL (INS_HUMAN)
AKWMRLLPF

SEQ ID NO: 35109 - protein, 9 aa, Artificial Sequence
  Description of Artificial Sequence: Synthetic peptide
  Seed: RLLPLLALL (INS_HUMAN)
RLLPLLALI

SEQ ID NO: 35110 - protein, 10 aa, Artificial Sequence
  Description of Artificial Sequence: Synthetic peptide
  Seed: VNQHLCGSHL (INS_HUMAN)
VLQHLCGSHF

SEQ ID NO: 35111 - protein, 11 aa, Artificial Sequence
  Description of Artificial Sequence: Synthetic peptide
  Seed: GSHLVEALYLV (INS_HUMAN)
GCHLVEALYLV

SEQ ID NO: 35112 - protein, 10 aa, Artificial Sequence
  Description of Artificial Sequence: Synthetic peptide
  Seed: GIVEQCCTSI (INS_HUMAN)
GMVEQCCTSL

SEQ ID NO: 35113 - protein, 11 aa, Artificial Sequence
  Description of Artificial Sequence: Synthetic peptide
  Seed: GSHLVEALYLV (INS_HUMAN)
GFHLVEALYLI

SEQ ID NO: 35114 - protein, 10 aa, Artificial Sequence
  Description of Artificial Sequence: Synthetic peptide
  Seed: HLVEALYLVC (INS_HUMAN)
HMVEALYLVD

SEQ ID NO: 35115 - protein, 8 aa, Artificial Sequence
  Description of Artificial Sequence: Synthetic peptide
  Seed: RGFFYTPK (INS_HUMAN)
RSFFYTPR

SEQ ID NO: 35116 - protein, 11 aa, Artificial Sequence
  Description of Artificial Sequence: Synthetic peptide
  Seed: SHLVEALYLVC (INS_HUMAN)
SMLVEALYLVD

SEQ ID NO: 35117 - protein, 10 aa, Artificial Sequence
  Description of Artificial Sequence: Synthetic peptide
  Seed: MALWMRLLPL (INS_HUMAN)
MCLWMRLLPA

SEQ ID NO: 35118 - protein, 11 aa, Artificial Sequence
  Description of Artificial Sequence: Synthetic peptide
  Seed: SHLVEALYLVC (INS_HUMAN)
SRLVEALYLVV

SEQ ID NO: 35119 - protein, 9 aa, Artificial Sequence
  Description of Artificial Sequence: Synthetic peptide
  Seed: LALEGSLQK (INS_HUMAN)
LILEGSLQL

SEQ ID NO: 35120 - protein, 8 aa, Artificial Sequence
  Description of Artificial Sequence: Synthetic peptide
  Seed: GPDPAAAF (INS_HUMAN)
GTDPAAAM

SEQ ID NO: 35121 - protein, 10 aa, Artificial Sequence
  Description of Artificial Sequence: Synthetic peptide
  Seed: GERGFFYTPK (INS_HUMAN)
GRRGFFYTPK

SEQ ID NO: 35122 - protein, 10 aa, Artificial Sequence
  Description of Artificial Sequence: Synthetic peptide
  Seed: MRLLPLLALL (INS_HUMAN)
MVLLPLLALI

SEQ ID NO: 35123 - protein, 10 aa, Artificial Sequence
  Description of Artificial Sequence: Synthetic peptide
  Seed: ALWGPDPAAA (INS_HUMAN)
ALWGPDPAAK

SEQ ID NO: 35124 - protein, 9 aa, Artificial Sequence
  Description of Artificial Sequence: Synthetic peptide
  Seed: AEDLQVGQV (INS_HUMAN)
AYDLQVGQM

SEQ ID NO: 35125 - protein, 9 aa, Artificial Sequence
  Description of Artificial Sequence: Synthetic peptide
  Seed: LPLLALLAL (INS_HUMAN)
LMLLALLAY

SEQ ID NO: 35126 - protein, 10 aa, Artificial Sequence
  Description of Artificial Sequence: Synthetic peptide
  Seed: LLPLLALLAL (INS_HUMAN)
LQPLLALLAY

SEQ ID NO: 35127 - protein, 8 aa, Artificial Sequence
  Description of Artificial Sequence: Synthetic peptide
  Seed: LWMRLLPL (INS_HUMAN)
LAMRLLPL

SEQ ID NO: 35128 - protein, 10 aa, Artificial Sequence
  Description of Artificial Sequence: Synthetic peptide
  Seed: MRLLPLLALL (INS_HUMAN)
MSLLPLLALV

SEQ ID NO: 35129 - protein, 11 aa, Artificial Sequence
  Description of Artificial Sequence: Synthetic peptide
  Seed: MALWMRLLPLL (INS_HUMAN)
MDLWMRLLPLF

SEQ ID NO: 35130 - protein, 10 aa, Artificial Sequence
  Description of Artificial Sequence: Synthetic peptide
  Seed: MALWMRLLPL (INS_HUMAN)
MGLWMRLLPA

SEQ ID NO: 35131 - protein, 11 aa, Artificial Sequence
  Description of Artificial Sequence: Synthetic peptide
  Seed: GQVELGGGPGA (INS_HUMAN)
GEVELGGGPGV

SEQ ID NO: 35132 - protein, 9 aa, Artificial Sequence
  Description of Artificial Sequence: Synthetic peptide
  Seed: TSICSLYQL (INS_HUMAN)
TAICSLYQA

SEQ ID NO: 35133 - protein, 10 aa, Artificial Sequence
  Description of Artificial Sequence: Synthetic peptide
  Seed: WGPDPAAAFV (INS_HUMAN)
WIPDPAAAFL

SEQ ID NO: 35134 - protein, 10 aa, Artificial Sequence
  Description of Artificial Sequence: Synthetic peptide
  Seed: MALWMRLLPL (INS_HUMAN)
MHLWMRLLPL

SEQ ID NO: 35135 - protein, 11 aa, Artificial Sequence
  Description of Artificial Sequence: Synthetic peptide
  Seed: KTRREAEDLQV (INS_HUMAN)
KTRREAEDLQF

SEQ ID NO: 35136 - protein, 10 aa, Artificial Sequence
  Description of Artificial Sequence: Synthetic peptide
  Seed: HLCGSHLVEA (INS_HUMAN)
HICGSHLVEL

SEQ ID NO: 35137 - protein, 10 aa, Artificial Sequence
  Description of Artificial Sequence: Synthetic peptide
  Seed: ALWMRLLPLL (INS_HUMAN)
APWMRLLPLF

SEQ ID NO: 35138 - protein, 8 aa, Artificial Sequence
  Description of Artificial Sequence: Synthetic peptide
  Seed: LWMRLLPL (INS_HUMAN)
LMMRLLPM

SEQ ID NO: 35139 - protein, 10 aa, Artificial Sequence
  Description of Artificial Sequence: Synthetic peptide
  Seed: HLCGSHLVEA (INS_HUMAN)
HQCGSHLVEV

SEQ ID NO: 35140 - protein, 10 aa, Artificial Sequence
  Description of Artificial Sequence: Synthetic peptide
  Seed: WMRLLPLLAL (INS_HUMAN)
WYRLLPLLAI

SEQ ID NO: 35141 - protein, 9 aa, Artificial Sequence
  Description of Artificial Sequence: Synthetic peptide
  Seed: RLLPLLALL (INS_HUMAN)
RQLPLLALA

SEQ ID NO: 35142 - protein, 9 aa, Artificial Sequence
  Description of Artificial Sequence: Synthetic peptide
  Seed: FVNQHLCGS (INS_HUMAN)
FQNQHLCGT

SEQ ID NO: 35143 - protein, 11 aa, Artificial Sequence
  Description of Artificial Sequence: Synthetic peptide
  Seed: GSHLVEALYLV (INS_HUMAN)
GEHLVEALYLV

SEQ ID NO: 35144 - protein, 10 aa, Artificial Sequence
  Description of Artificial Sequence: Synthetic peptide
  Seed: RGFFYTPKTR (INS_HUMAN)
RYFFYTPKTR

SEQ ID NO: 35145 - protein, 9 aa, Artificial Sequence
  Description of Artificial Sequence: Synthetic peptide
  Seed: AAAFVNQHL (INS_HUMAN)
ASAFVNQHW

SEQ ID NO: 35146 - protein, 9 aa, Artificial Sequence
  Description of Artificial Sequence: Synthetic peptide
  Seed: LALWGPDPA (INS_HUMAN)
LTLWGPDPV

SEQ ID NO: 35147 - protein, 10 aa, Artificial Sequence
  Description of Artificial Sequence: Synthetic peptide
  Seed: WMRLLPLLAL (INS_HUMAN)
WRRLLPLLAK

SEQ ID NO: 35148 - protein, 9 aa, Artificial Sequence
  Description of Artificial Sequence: Synthetic peptide
  Seed: FFYTPKTRR (INS_HUMAN)
FIYTPKTRR

SEQ ID NO: 35149 - protein, 10 aa, Artificial Sequence
  Description of Artificial Sequence: Synthetic peptide
  Seed: AEDLQVGQVE (INS_HUMAN)
AEDLQVGQVL

SEQ ID NO: 35150 - protein, 9 aa, Artificial Sequence
  Description of Artificial Sequence: Synthetic peptide
  Seed: AGSLQPLAL (INS_HUMAN)
ASSLQPLAL

SEQ ID NO: 35151 - protein, 10 aa, Artificial Sequence
  Description of Artificial Sequence: Synthetic peptide
  Seed: VNQHLCGSHL (INS_HUMAN)
VEQHLCGSHY

SEQ ID NO: 35152 - protein, 9 aa, Artificial Sequence
  Description of Artificial Sequence: Synthetic peptide
  Seed: MRLLPLLAL (INS_HUMAN)
MHLLPLLAY

SEQ ID NO: 35153 - protein, 9 aa, Artificial Sequence
  Description of Artificial Sequence: Synthetic peptide
  Seed: WGPDPAAAF (INS_HUMAN)
WFPDPAAAI

SEQ ID NO: 35154 - protein, 9 aa, Artificial Sequence
  Description of Artificial Sequence: Synthetic peptide
  Seed: ALYLVCGER (INS_HUMAN)
AAYLVCGER

SEQ ID NO: 35155 - protein, 10 aa, Artificial Sequence
  Description of Artificial Sequence: Synthetic peptide
  Seed: MALWMRLLPL (INS_HUMAN)
MALWMRLLPW

SEQ ID NO: 35156 - protein, 10 aa, Artificial Sequence
  Description of Artificial Sequence: Synthetic peptide
  Seed: MALWMRLLPL (INS_HUMAN)
MGLWMRLLPF

SEQ ID NO: 35157 - protein, 10 aa, Artificial Sequence
  Description of Artificial Sequence: Synthetic peptide
  Seed: REAEDLQVGQ (INS_HUMAN)
REAEDLQVGF

SEQ ID NO: 35158 - protein, 9 aa, Artificial Sequence
  Description of Artificial Sequence: Synthetic peptide
  Seed: TSICSLYQL (INS_HUMAN)
TSICSLYQW

SEQ ID NO: 35159 - protein, 11 aa, Artificial Sequence
  Description of Artificial Sequence: Synthetic peptide
  Seed: GSHLVEALYLV (INS_HUMAN)
GGHLVEALYLL

SEQ ID NO: 35160 - protein, 10 aa, Artificial Sequence
  Description of Artificial Sequence: Synthetic peptide
  Seed: WMRLLPLLAL (INS_HUMAN)
WKRLLPLLAM

SEQ ID NO: 35161 - protein, 11 aa, Artificial Sequence
  Description of Artificial Sequence: Synthetic peptide
  Seed: GSHLVEALYLV (INS_HUMAN)
GKHLVEALYLV

SEQ ID NO: 35162 - protein, 9 aa, Artificial Sequence
  Description of Artificial Sequence: Synthetic peptide
  Seed: LWMRLLPLL (INS_HUMAN)
LMMRLLPLY

SEQ ID NO: 35163 - protein, 9 aa, Artificial Sequence
  Description of Artificial Sequence: Synthetic peptide
  Seed: MRLLPLLAL (INS_HUMAN)
MQLLPLLAM

SEQ ID NO: 35164 - protein, 9 aa, Artificial Sequence
  Description of Artificial Sequence: Synthetic peptide
  Seed: RLLPLLALL (INS_HUMAN)
RQLPLLALV

SEQ ID NO: 35165 - protein, 8 aa, Artificial Sequence
  Description of Artificial Sequence: Synthetic peptide
  Seed: LWMRLLPL (INS_HUMAN)
LYMRLLPM

SEQ ID NO: 35166 - protein, 11 aa, Artificial Sequence
  Description of Artificial Sequence: Synthetic peptide
  Seed: ALWGPDPAAAF (INS_HUMAN)
ATWGPDPAAAH

SEQ ID NO: 35167 - protein, 10 aa, Artificial Sequence
  Description of Artificial Sequence: Synthetic peptide
  Seed: LALWGPDPAA (INS_HUMAN)
LPLWGPDPAV

SEQ ID NO: 35168 - protein, 8 aa, Artificial Sequence
  Description of Artificial Sequence: Synthetic peptide
  Seed: RGFFYTPK (INS_HUMAN)
RMFFYTPR

SEQ ID NO: 35169 - protein, 11 aa, Artificial Sequence
  Description of Artificial Sequence: Synthetic peptide
  Seed: SHLVEALYLVC (INS_HUMAN)
SLLVEALYLVL

SEQ ID NO: 35170 - protein, 9 aa, Artificial Sequence
  Description of Artificial Sequence: Synthetic peptide
  Seed: FVNQHLCGS (INS_HUMAN)
FVNQHLCGL

SEQ ID NO: 35171 - protein, 9 aa, Artificial Sequence
  Description of Artificial Sequence: Synthetic peptide
  Seed: REAEDLQVG (INS_HUMAN)
REAEDLQVF

SEQ ID NO: 35172 - protein, 10 aa, Artificial Sequence
  Description of Artificial Sequence: Synthetic peptide
  Seed: RLLPLLALLA (INS_HUMAN)
RLLPLLALLE

SEQ ID NO: 35173 - protein, 11 aa, Artificial Sequence
  Description of Artificial Sequence: Synthetic peptide
  Seed: MALWMRLLPLL (INS_HUMAN)
MILWMRLLPLV

SEQ ID NO: 35174 - protein, 9 aa, Artificial Sequence
  Description of Artificial Sequence: Synthetic peptide
  Seed: AEDLQVGQV (INS_HUMAN)
AEDLQVGQL

SEQ ID NO: 35175 - protein, 10 aa, Artificial Sequence
  Description of Artificial Sequence: Synthetic peptide
  Seed: MALWMRLLPL (INS_HUMAN)
MCLWMRLLPL

SEQ ID NO: 35176 - protein, 9 aa, Artificial Sequence
  Description of Artificial Sequence: Synthetic peptide
  Seed: AEDLQVGQV (INS_HUMAN)
AYDLQVGQL

SEQ ID NO: 35177 - protein, 9 aa, Artificial Sequence
  Description of Artificial Sequence: Synthetic peptide
  Seed: ALWMRLLPL (INS_HUMAN)
ALWMRLLPT

SEQ ID NO: 35178 - protein, 10 aa, Artificial Sequence
  Description of Artificial Sequence: Synthetic peptide
  Seed: LPLLALLALW (INS_HUMAN)
LGLLALLALW

SEQ ID NO: 35179 - protein, 11 aa, Artificial Sequence
  Description of Artificial Sequence: Synthetic peptide
  Seed: WMRLLPLLALL (INS_HUMAN)
WYRLLPLLALV

SEQ ID NO: 35180 - protein, 9 aa, Artificial Sequence
  Description of Artificial Sequence: Synthetic peptide
  Seed: GSHLVEALY (INS_HUMAN)
GAHLVEALW

SEQ ID NO: 35181 - protein, 10 aa, Artificial Sequence
  Description of Artificial Sequence: Synthetic peptide
  Seed: MRLLPLLALL (INS_HUMAN)
MCLLPLLALA

SEQ ID NO: 35182 - protein, 9 aa, Artificial Sequence
  Description of Artificial Sequence: Synthetic peptide
  Seed: HLVEALYLV (INS_HUMAN)
HQVEALYLL

SEQ ID NO: 35183 - protein, 10 aa, Artificial Sequence
  Description of Artificial Sequence: Synthetic peptide
  Seed: SHLVEALYLV (INS_HUMAN)
SVLVEALYLV

SEQ ID NO: 35184 - protein, 10 aa, Artificial Sequence
  Description of Artificial Sequence: Synthetic peptide
  Seed: MRLLPLLALL (INS_HUMAN)
MRLLPLLALY

SEQ ID NO: 35185 - protein, 9 aa, Artificial Sequence
  Description of Artificial Sequence: Synthetic peptide
  Seed: RLLPLLALL (INS_HUMAN)
RVLPLLALM

SEQ ID NO: 35186 - protein, 9 aa, Artificial Sequence
  Description of Artificial Sequence: Synthetic peptide
  Seed: AAFVNQHLC (INS_HUMAN)
ATFVNQHLF

SEQ ID NO: 35187 - protein, 9 aa, Artificial Sequence
  Description of Artificial Sequence: Synthetic peptide
  Seed: AAAFVNQHL (INS_HUMAN)
AVAFVNQHY

SEQ ID NO: 35188 - protein, 10 aa, Artificial Sequence
  Description of Artificial Sequence: Synthetic peptide
  Seed: LLPLLALLAL (INS_HUMAN)
LKPLLALLAY

SEQ ID NO: 35189 - protein, 9 aa, Artificial Sequence
  Description of Artificial Sequence: Synthetic peptide
  Seed: VCGERGFFY (INS_HUMAN)
VYGERGFFY

SEQ ID NO: 35190 - protein, 9 aa, Artificial Sequence
  Description of Artificial Sequence: Synthetic peptide
  Seed: AAFVNQHLC (INS_HUMAN)
ACFVNQHLW

SEQ ID NO: 35191 - protein, 9 aa, Artificial Sequence
  Description of Artificial Sequence: Synthetic peptide
  Seed: ALWMRLLPL (INS_HUMAN)
AQWMRLLPM

SEQ ID NO: 35192 - protein, 9 aa, Artificial Sequence
  Description of Artificial Sequence: Synthetic peptide
  Seed: MRLLPLLAL (INS_HUMAN)
MKLLPLLAM

SEQ ID NO: 35193 - protein, 10 aa, Artificial Sequence
  Description of Artificial Sequence: Synthetic peptide
  Seed: RLLPLLALLA (INS_HUMAN)
RVLPLLALLV

SEQ ID NO: 35194 - protein, 8 aa, Artificial Sequence
  Description of Artificial Sequence: Synthetic peptide
  Seed: GPDPAAAF (INS_HUMAN)
GADPAAAI

SEQ ID NO: 35195 - protein, 9 aa, Artificial Sequence
  Description of Artificial Sequence: Synthetic peptide
  Seed: HLVEALYLV (INS_HUMAN)
HTVEALYLK

SEQ ID NO: 35196 - protein, 10 aa, Artificial Sequence
  Description of Artificial Sequence: Synthetic peptide
  Seed: RLLPLLALLA (INS_HUMAN)
RLLPLLALLK

SEQ ID NO: 35197 - protein, 10 aa, Artificial Sequence
  Description of Artificial Sequence: Synthetic peptide
  Seed: HLVEALYLVC (INS_HUMAN)
HQVEALYLVM

SEQ ID NO: 35198 - protein, 9 aa, Artificial Sequence
  Description of Artificial Sequence: Synthetic peptide
  Seed: LALWGPDPA (INS_HUMAN)
LMLWGPDPL

SEQ ID NO: 35199 - protein, 9 aa, Artificial Sequence
  Description of Artificial Sequence: Synthetic peptide
  Seed: REAEDLQVG (INS_HUMAN)
REAEDLQVY

SEQ ID NO: 35200 - protein, 10 aa, Artificial Sequence
  Description of Artificial Sequence: Synthetic peptide
  Seed: WMRLLPLLAL (INS_HUMAN)
WVRLLPLLAM

SEQ ID NO: 35201 - protein, 9 aa, Artificial Sequence
  Description of Artificial Sequence: Synthetic peptide
  Seed: LALEGSLQK (INS_HUMAN)
LALEGSLQL

SEQ ID NO: 35202 - protein, 9 aa, Artificial Sequence
  Description of Artificial Sequence: Synthetic peptide
  Seed: LALEGSLQK (INS_HUMAN)
LILEGSLQR

SEQ ID NO: 35203 - protein, 9 aa, Artificial Sequence
  Description of Artificial Sequence: Synthetic peptide
  Seed: RLLPLLALL (INS_HUMAN)
RILPLLALK

SEQ ID NO: 35204 - protein, 9 aa, Artificial Sequence
  Description of Artificial Sequence: Synthetic peptide
  Seed: VELGGGPGA (INS_HUMAN)
VELGGGPGT

SEQ ID NO: 35205 - protein, 10 aa, Artificial Sequence
  Description of Artificial Sequence: Synthetic peptide
  Seed: CGSHLVEALY (INS_HUMAN)
CFSHLVEALY

SEQ ID NO: 35206 - protein, 10 aa, Artificial Sequence
  Description of Artificial Sequence: Synthetic peptide
  Seed: WGPDPAAAFV (INS_HUMAN)
WHPDPAAAFL

SEQ ID NO: 35207 - protein, 9 aa, Artificial Sequence
  Description of Artificial Sequence: Synthetic peptide
  Seed: AEDLQVGQV (INS_HUMAN)
ALDLQVGQI

SEQ ID NO: 35208 - protein, 9 aa, Artificial Sequence
  Description of Artificial Sequence: Synthetic peptide
  Seed: HLVEALYLV (INS_HUMAN)
HMVEALYLM

SEQ ID NO: 35209 - protein, 9 aa, Artificial Sequence
  Description of Artificial Sequence: Synthetic peptide
  Seed: NQHLCGSHL (INS_HUMAN)
NEHLCGSHL

SEQ ID NO: 35210 - protein, 9 aa, Artificial Sequence
  Description of Artificial Sequence: Synthetic peptide
  Seed: AAFVNQHLC (INS_HUMAN)
ASFVNQHLY

SEQ ID NO: 35211 - protein, 9 aa, Artificial Sequence
  Description of Artificial Sequence: Synthetic peptide
  Seed: TSICSLYQL (INS_HUMAN)
TSICSLYQV

SEQ ID NO: 35212 - protein, 9 aa, Artificial Sequence
  Description of Artificial Sequence: Synthetic peptide
  Seed: ALWMRLLPL (INS_HUMAN)
AIWMRLLPV

SEQ ID NO: 35213 - protein, 10 aa, Artificial Sequence
  Description of Artificial Sequence: Synthetic peptide
  Seed: RLLPLLALLA (INS_HUMAN)
RMLPLLALLM

SEQ ID NO: 35214 - protein, 9 aa, Artificial Sequence
  Description of Artificial Sequence: Synthetic peptide
  Seed: WGPDPAAAF (INS_HUMAN)
WIPDPAAAI

SEQ ID NO: 35215 - protein, 9 aa, Artificial Sequence
  Description of Artificial Sequence: Synthetic peptide
  Seed: AEDLQVGQV (INS_HUMAN)
AIDLQVGQM

SEQ ID NO: 35216 - protein, 10 aa, Artificial Sequence
  Description of Artificial Sequence: Synthetic peptide
  Seed: MRLLPLLALL (INS_HUMAN)
MFLLPLLALM

SEQ ID NO: 35217 - protein, 9 aa, Artificial Sequence
  Description of Artificial Sequence: Synthetic peptide
  Seed: MRLLPLLAL (INS_HUMAN)
MQLLPLLAA

SEQ ID NO: 35218 - protein, 9 aa, Artificial Sequence
  Description of Artificial Sequence: Synthetic peptide
  Seed: WGPDPAAAF (INS_HUMAN)
WTPDPAAAM

SEQ ID NO: 35219 - protein, 9 aa, Artificial Sequence
  Description of Artificial Sequence: Synthetic peptide
  Seed: ALWMRLLPL (INS_HUMAN)
AMWMRLLPM

SEQ ID NO: 35220 - protein, 11 aa, Artificial Sequence
  Description of Artificial Sequence: Synthetic peptide
  Seed: ALWGPDPAAAF (INS_HUMAN)
ATWGPDPAAAL

SEQ ID NO: 35221 - protein, 9 aa, Artificial Sequence
  Description of Artificial Sequence: Synthetic peptide
  Seed: CCTSICSLY (INS_HUMAN)
CVTSICSLY

SEQ ID NO: 35222 - protein, 11 aa, Artificial Sequence
  Description of Artificial Sequence: Synthetic peptide
  Seed: HLCGSHLVEAL (INS_HUMAN)
HMCGSHLVEAF

SEQ ID NO: 35223 - protein, 9 aa, Artificial Sequence
  Description of Artificial Sequence: Synthetic peptide
  Seed: TSICSLYQL (INS_HUMAN)
TQICSLYQT

SEQ ID NO: 35224 - protein, 10 aa, Artificial Sequence
  Description of Artificial Sequence: Synthetic peptide
  Seed: ALWMRLLPLL (INS_HUMAN)
ADWMRLLPLF

SEQ ID NO: 35225 - protein, 9 aa, Artificial Sequence
  Description of Artificial Sequence: Synthetic peptide
  Seed: MRLLPLLAL (INS_HUMAN)
MHLLPLLAA

SEQ ID NO: 35226 - protein, 10 aa, Artificial Sequence
  Description of Artificial Sequence: Synthetic peptide
  Seed: WMRLLPLLAL (INS_HUMAN)
WRRLLPLLAL

SEQ ID NO: 35227 - protein, 10 aa, Artificial Sequence
  Description of Artificial Sequence: Synthetic peptide
  Seed: MALWMRLLPL (INS_HUMAN)
MWLWMRLLPF

SEQ ID NO: 35228 - protein, 10 aa, Artificial Sequence
  Description of Artificial Sequence: Synthetic peptide
  Seed: MALWMRLLPL (INS_HUMAN)
MNLWMRLLPI

SEQ ID NO: 35229 - protein, 10 aa, Artificial Sequence
  Description of Artificial Sequence: Synthetic peptide
  Seed: MALWMRLLPL (INS_HUMAN)
MALWMRLLPY

SEQ ID NO: 35230 - protein, 10 aa, Artificial Sequence
  Description of Artificial Sequence: Synthetic peptide
  Seed: SHLVEALYLV (INS_HUMAN)
SRLVEALYLM

SEQ ID NO: 35231 - protein, 9 aa, Artificial Sequence
  Description of Artificial Sequence: Synthetic peptide
  Seed: QHLCGSHLV (INS_HUMAN)
QHLCGSHLI

SEQ ID NO: 35232 - protein, 10 aa, Artificial Sequence
  Description of Artificial Sequence: Synthetic peptide
  Seed: RLLPLLALLA (INS_HUMAN)
RLLPLLALLI

SEQ ID NO: 35233 - protein, 9 aa, Artificial Sequence
  Description of Artificial Sequence: Synthetic peptide
  Seed: AEDLQVGQV (INS_HUMAN)
AMDLQVGQI

SEQ ID NO: 35234 - protein, 9 aa, Artificial Sequence
  Description of Artificial Sequence: Synthetic peptide
  Seed: RLLPLLALL (INS_HUMAN)
RMLPLLALA

SEQ ID NO: 35235 - protein, 11 aa, Artificial Sequence
  Description of Artificial Sequence: Synthetic peptide
  Seed: MALWMRLLPLL (INS_HUMAN)
MSLWMRLLPLV

SEQ ID NO: 35236 - protein, 10 aa, Artificial Sequence
  Description of Artificial Sequence: Synthetic peptide
  Seed: CTSICSLYQL (INS_HUMAN)
CLSICSLYQV

SEQ ID NO: 35237 - protein, 10 aa, Artificial Sequence
  Description of Artificial Sequence: Synthetic peptide
  Seed: ALWGPDPAAA (INS_HUMAN)
AMWGPDPAAK

SEQ ID NO: 35238 - protein, 10 aa, Artificial Sequence
  Description of Artificial Sequence: Synthetic peptide
  Seed: WMRLLPLLAL (INS_HUMAN)
WYRLLPLLAK

SEQ ID NO: 35239 - protein, 10 aa, Artificial Sequence
  Description of Artificial Sequence: Synthetic peptide
  Seed: RGFFYTPKTR (INS_HUMAN)
RIFFYTPKTR

SEQ ID NO: 35240 - protein, 9 aa, Artificial Sequence
  Description of Artificial Sequence: Synthetic peptide
  Seed: HLVEALYLV (INS_HUMAN)
HQVEALYLT

SEQ ID NO: 35241 - protein, 10 aa, Artificial Sequence
  Description of Artificial Sequence: Synthetic peptide
  Seed: MRLLPLLALL (INS_HUMAN)
MALLPLLALV

SEQ ID NO: 35242 - protein, 11 aa, Artificial Sequence
  Description of Artificial Sequence: Synthetic peptide
  Seed: HLCGSHLVEAL (INS_HUMAN)
HQCGSHLVEAW

SEQ ID NO: 35243 - protein, 10 aa, Artificial Sequence
  Description of Artificial Sequence: Synthetic peptide
  Seed: WGPDPAAAFV (INS_HUMAN)
WCPDPAAAFL

SEQ ID NO: 35244 - protein, 8 aa, Artificial Sequence
  Description of Artificial Sequence: Synthetic peptide
  Seed: LVEALYLV (INS_HUMAN)
LFEALYLL

SEQ ID NO: 35245 - protein, 9 aa, Artificial Sequence
  Description of Artificial Sequence: Synthetic peptide
  Seed: YTPKTRREA (INS_HUMAN)
YAPKTRREM

SEQ ID NO: 35246 - protein, 11 aa, Artificial Sequence
  Description of Artificial Sequence: Synthetic peptide
  Seed: ALWGPDPAAAF (INS_HUMAN)
AQWGPDPAAAL

SEQ ID NO: 35247 - protein, 11 aa, Artificial Sequence
  Description of Artificial Sequence: Synthetic peptide
  Seed: ALWGPDPAAAF (INS_HUMAN)
AVWGPDPAAAM

SEQ ID NO: 35248 - protein, 9 aa, Artificial Sequence
  Description of Artificial Sequence: Synthetic peptide
  Seed: RLLPLLALL (INS_HUMAN)
RSLPLLALV

SEQ ID NO: 35249 - protein, 9 aa, Artificial Sequence
  Description of Artificial Sequence: Synthetic peptide
  Seed: ALWMRLLPL (INS_HUMAN)
ANWMRLLPF

SEQ ID NO: 35250 - protein, 9 aa, Artificial Sequence
  Description of Artificial Sequence: Synthetic peptide
  Seed: ALWMRLLPL (INS_HUMAN)
AMWMRLLPR

SEQ ID NO: 35251 - protein, 11 aa, Artificial Sequence
  Description of Artificial Sequence: Synthetic peptide
  Seed: REAEDLQVGQV (INS_HUMAN)
REAEDLQVGQM

SEQ ID NO: 35252 - protein, 10 aa, Artificial Sequence
  Description of Artificial Sequence: Synthetic peptide
  Seed: ALWMRLLPLL (INS_HUMAN)
AYWMRLLPLM

SEQ ID NO: 35253 - protein, 11 aa, Artificial Sequence
  Description of Artificial Sequence: Synthetic peptide
  Seed: RGFFYTPKTRR (INS_HUMAN)
RKFFYTPKTRR

SEQ ID NO: 35254 - protein, 9 aa, Artificial Sequence
  Description of Artificial Sequence: Synthetic peptide
  Seed: FVNQHLCGS (INS_HUMAN)
FLNQHLCGL

SEQ ID NO: 35255 - protein, 10 aa, Artificial Sequence
  Description of Artificial Sequence: Synthetic peptide
  Seed: MALWMRLLPL (INS_HUMAN)
MYLWMRLLPM

SEQ ID NO: 35256 - protein, 9 aa, Artificial Sequence
  Description of Artificial Sequence: Synthetic peptide
  Seed: WMRLLPLLA (INS_HUMAN)
WMRLLPLLV

SEQ ID NO: 35257 - protein, 11 aa, Artificial Sequence
  Description of Artificial Sequence: Synthetic peptide
  Seed: GSHLVEALYLV (INS_HUMAN)
GYHLVEALYLL

SEQ ID NO: 35258 - protein, 10 aa, Artificial Sequence
  Description of Artificial Sequence: Synthetic peptide
  Seed: LQPLALEGSL (INS_HUMAN)
LQPLALEGSF

SEQ ID NO: 35259 - protein, 9 aa, Artificial Sequence
  Description of Artificial Sequence: Synthetic peptide
  Seed: LALWGPDPA (INS_HUMAN)
LMLWGPDPI

SEQ ID NO: 35260 - protein, 10 aa, Artificial Sequence
  Description of Artificial Sequence: Synthetic peptide
  Seed: LLPLLALLAL (INS_HUMAN)
LMPLLALLAL

SEQ ID NO: 35261 - protein, 9 aa, Artificial Sequence
  Description of Artificial Sequence: Synthetic peptide
  Seed: LALWGPDPA (INS_HUMAN)
LQLWGPDPV

SEQ ID NO: 35262 - protein, 10 aa, Artificial Sequence
  Description of Artificial Sequence: Synthetic peptide
  Seed: MALWMRLLPL (INS_HUMAN)
MPLWMRLLPY

SEQ ID NO: 35263 - protein, 11 aa, Artificial Sequence
  Description of Artificial Sequence: Synthetic peptide
  Seed: LWMRLLPLLAL (INS_HUMAN)
LYMRLLPLLAW

SEQ ID NO: 35264 - protein, 10 aa, Artificial Sequence
  Description of Artificial Sequence: Synthetic peptide
  Seed: LWGPDPAAAF (INS_HUMAN)
LQGPDPAAAF

SEQ ID NO: 35265 - protein, 9 aa, Artificial Sequence
  Description of Artificial Sequence: Synthetic peptide
  Seed: WGPDPAAAF (INS_HUMAN)
WSPDPAAAI

SEQ ID NO: 35266 - protein, 10 aa, Artificial Sequence
  Description of Artificial Sequence: Synthetic peptide
  Seed: MALWMRLLPL (INS_HUMAN)
MDLWMRLLPA

SEQ ID NO: 35267 - protein, 9 aa, Artificial Sequence
  Description of Artificial Sequence: Synthetic peptide
  Seed: ALWMRLLPL (INS_HUMAN)
AKWMRLLPM

SEQ ID NO: 35268 - protein, 9 aa, Artificial Sequence
  Description of Artificial Sequence: Synthetic peptide
  Seed: AAAFVNQHL (INS_HUMAN)
AVAFVNQHV

SEQ ID NO: 35269 - protein, 9 aa, Artificial Sequence
  Description of Artificial Sequence: Synthetic peptide
  Seed: HLVEALYLV (INS_HUMAN)
HTVEALYLL

SEQ ID NO: 35270 - protein, 9 aa, Artificial Sequence
  Description of Artificial Sequence: Synthetic peptide
  Seed: MRLLPLLAL (INS_HUMAN)
MHLLPLLAM

SEQ ID NO: 35271 - protein, 9 aa, Artificial Sequence
  Description of Artificial Sequence: Synthetic peptide
  Seed: AEDLQVGQV (INS_HUMAN)
ASDLQVGQM

SEQ ID NO: 35272 - protein, 10 aa, Artificial Sequence
  Description of Artificial Sequence: Synthetic peptide
  Seed: WMRLLPLLAL (INS_HUMAN)
WMRLLPLLAF

SEQ ID NO: 35273 - protein, 9 aa, Artificial Sequence
  Description of Artificial Sequence: Synthetic peptide
  Seed: RLLPLLALL (INS_HUMAN)
RVLPLLALA

SEQ ID NO: 35274 - protein, 10 aa, Artificial Sequence
  Description of Artificial Sequence: Synthetic peptide
  Seed: LLPLLALLAL (INS_HUMAN)
LMPLLALLAM

SEQ ID NO: 35275 - protein, 9 aa, Artificial Sequence
  Description of Artificial Sequence: Synthetic peptide
  Seed: RLLPLLALL (INS_HUMAN)
RWLPLLALI

SEQ ID NO: 35276 - protein, 11 aa, Artificial Sequence
  Description of Artificial Sequence: Synthetic peptide
  Seed: ALWGPDPAAAF (INS_HUMAN)
AAWGPDPAAAL

SEQ ID NO: 35277 - protein, 9 aa, Artificial Sequence
  Description of Artificial Sequence: Synthetic peptide
  Seed: AGSLQPLAL (INS_HUMAN)
AASLQPLAY

SEQ ID NO: 35278 - protein, 9 aa, Artificial Sequence
  Description of Artificial Sequence: Synthetic peptide
  Seed: AGSLQPLAL (INS_HUMAN)
ALSLQPLAY

SEQ ID NO: 35279 - protein, 9 aa, Artificial Sequence
  Description of Artificial Sequence: Synthetic peptide
  Seed: TSICSLYQL (INS_HUMAN)
TIICSLYQM

SEQ ID NO: 35280 - protein, 9 aa, Artificial Sequence
  Description of Artificial Sequence: Synthetic peptide
  Seed: AEDLQVGQV (INS_HUMAN)
AGDLQVGQI

SEQ ID NO: 35281 - protein, 11 aa, Artificial Sequence
  Description of Artificial Sequence: Synthetic peptide
  Seed: GSHLVEALYLV (INS_HUMAN)
GYHLVEALYLI

SEQ ID NO: 35282 - protein, 9 aa, Artificial Sequence
  Description of Artificial Sequence: Synthetic peptide
  Seed: FVNQHLCGS (INS_HUMAN)
FMNQHLCGV

SEQ ID NO: 35283 - protein, 9 aa, Artificial Sequence
  Description of Artificial Sequence: Synthetic peptide
  Seed: GPDPAAAFV (INS_HUMAN)
GYDPAAAFI

SEQ ID NO: 35284 - protein, 8 aa, Artificial Sequence
  Description of Artificial Sequence: Synthetic peptide
  Seed: LVEALYLV (INS_HUMAN)
LMEALYLL

SEQ ID NO: 35285 - protein, 10 aa, Artificial Sequence
  Description of Artificial Sequence: Synthetic peptide
  Seed: LWGPDPAAAF (INS_HUMAN)
LAGPDPAAAY

SEQ ID NO: 35286 - protein, 9 aa, Artificial Sequence
  Description of Artificial Sequence: Synthetic peptide
  Seed: WGPDPAAAF (INS_HUMAN)
WGPDPAAAL

SEQ ID NO: 35287 - protein, 11 aa, Artificial Sequence
  Description of Artificial Sequence: Synthetic peptide
  Seed: ELGGGPGAGSL (INS_HUMAN)
EQGGGPGAGSY

SEQ ID NO: 35288 - protein, 10 aa, Artificial Sequence
  Description of Artificial Sequence: Synthetic peptide
  Seed: EALYLVCGER (INS_HUMAN)
EFLYLVCGER

SEQ ID NO: 35289 - protein, 9 aa, Artificial Sequence
  Description of Artificial Sequence: Synthetic peptide
  Seed: AGSLQPLAL (INS_HUMAN)
ASSLQPLAI

SEQ ID NO: 35290 - protein, 9 aa, Artificial Sequence
  Description of Artificial Sequence: Synthetic peptide
  Seed: TSICSLYQL (INS_HUMAN)
TMICSLYQA

SEQ ID NO: 35291 - protein, 9 aa, Artificial Sequence
  Description of Artificial Sequence: Synthetic peptide
  Seed: HLVEALYLV (INS_HUMAN)
HVVEALYLR

SEQ ID NO: 35292 - protein, 10 aa, Artificial Sequence
  Description of Artificial Sequence: Synthetic peptide
  Seed: MALWMRLLPL (INS_HUMAN)
MKLWMRLLPI

SEQ ID NO: 35293 - protein, 10 aa, Artificial Sequence
  Description of Artificial Sequence: Synthetic peptide
  Seed: ALWMRLLPLL (INS_HUMAN)
AFWMRLLPLF

SEQ ID NO: 35294 - protein, 10 aa, Artificial Sequence
  Description of Artificial Sequence: Synthetic peptide
  Seed: SHLVEALYLV (INS_HUMAN)
SKLVEALYLV

SEQ ID NO: 35295 - protein, 9 aa, Artificial Sequence
  Description of Artificial Sequence: Synthetic peptide
  Seed: WGPDPAAAF (INS_HUMAN)
WPPDPAAAM

SEQ ID NO: 35296 - protein, 9 aa, Artificial Sequence
  Description of Artificial Sequence: Synthetic peptide
  Seed: FVNQHLCGS (INS_HUMAN)
FINQHLCGT

SEQ ID NO: 35297 - protein, 10 aa, Artificial Sequence
  Description of Artificial Sequence: Synthetic peptide
  Seed: ALWMRLLPLL (INS_HUMAN)
ALWMRLLPLA

SEQ ID NO: 35298 - protein, 10 aa, Artificial Sequence
  Description of Artificial Sequence: Synthetic peptide
  Seed: HLVEALYLVC (INS_HUMAN)
HLVEALYLVW

SEQ ID NO: 35299 - protein, 10 aa, Artificial Sequence
  Description of Artificial Sequence: Synthetic peptide
  Seed: VNQHLCGSHL (INS_HUMAN)
VRQHLCGSHY

SEQ ID NO: 35300 - protein, 10 aa, Artificial Sequence
  Description of Artificial Sequence: Synthetic peptide
  Seed: LWGPDPAAAF (INS_HUMAN)
LQGPDPAAAY

SEQ ID NO: 35301 - protein, 9 aa, Artificial Sequence
  Description of Artificial Sequence: Synthetic peptide
  Seed: RLLPLLALL (INS_HUMAN)
RQLPLLALF

SEQ ID NO: 35302 - protein, 9 aa, Artificial Sequence
  Description of Artificial Sequence: Synthetic peptide
  Seed: TSICSLYQL (INS_HUMAN)
TLICSLYQV

SEQ ID NO: 35303 - protein, 9 aa, Artificial Sequence
  Description of Artificial Sequence: Synthetic peptide
  Seed: AGSLQPLAL (INS_HUMAN)
ARSLQPLAY

SEQ ID NO: 35304 - protein, 9 aa, Artificial Sequence
  Description of Artificial Sequence: Synthetic peptide
  Seed: HLVEALYLV (INS_HUMAN)
HSVEALYLL

SEQ ID NO: 35305 - protein, 10 aa, Artificial Sequence
  Description of Artificial Sequence: Synthetic peptide
  Seed: WMRLLPLLAL (INS_HUMAN)
WNRLLPLLAI

SEQ ID NO: 35306 - protein, 9 aa, Artificial Sequence
  Description of Artificial Sequence: Synthetic peptide
  Seed: VCGERGFFY (INS_HUMAN)
VQGERGFFY

SEQ ID NO: 35307 - protein, 11 aa, Artificial Sequence
  Description of Artificial Sequence: Synthetic peptide
  Seed: HLVEALYLVCG (INS_HUMAN)
HMVEALYLVCV

SEQ ID NO: 35308 - protein, 9 aa, Artificial Sequence
  Description of Artificial Sequence: Synthetic peptide
  Seed: CCTSICSLY (INS_HUMAN)
CITSICSLY

SEQ ID NO: 35309 - protein, 10 aa, Artificial Sequence
  Description of Artificial Sequence: Synthetic peptide
  Seed: LLPLLALLAL (INS_HUMAN)
LYPLLALLAM

SEQ ID NO: 35310 - protein, 9 aa, Artificial Sequence
  Description of Artificial Sequence: Synthetic peptide
  Seed: FVNQHLCGS (INS_HUMAN)
FVNQHLCGT

SEQ ID NO: 35311 - protein, 9 aa, Artificial Sequence
  Description of Artificial Sequence: Synthetic peptide
  Seed: WGPDPAAAF (INS_HUMAN)
WPPDPAAAL

SEQ ID NO: 35312 - protein, 11 aa, Artificial Sequence
  Description of Artificial Sequence: Synthetic peptide
  Seed: RLLPLLALLAL (INS_HUMAN)
RMLPLLALLAI

SEQ ID NO: 35313 - protein, 11 aa, Artificial Sequence
  Description of Artificial Sequence: Synthetic peptide
  Seed: GSHLVEALYLV (INS_HUMAN)
GLHLVEALYLV

SEQ ID NO: 35314 - protein, 9 aa, Artificial Sequence
  Description of Artificial Sequence: Synthetic peptide
  Seed: ALWMRLLPL (INS_HUMAN)
AAWMRLLPM

SEQ ID NO: 35315 - protein, 10 aa, Artificial Sequence
  Description of Artificial Sequence: Synthetic peptide
  Seed: WMRLLPLLAL (INS_HUMAN)
WSRLLPLLAL

SEQ ID NO: 35316 - protein, 10 aa, Artificial Sequence
  Description of Artificial Sequence: Synthetic peptide
  Seed: ALWMRLLPLL (INS_HUMAN)
AMWMRLLPLT

SEQ ID NO: 35317 - protein, 8 aa, Artificial Sequence
  Description of Artificial Sequence: Synthetic peptide
  Seed: GPDPAAAF (INS_HUMAN)
GSDPAAAM

SEQ ID NO: 35318 - protein, 9 aa, Artificial Sequence
  Description of Artificial Sequence: Synthetic peptide
  Seed: GPDPAAAFV (INS_HUMAN)
GSDPAAAFF

SEQ ID NO: 35319 - protein, 9 aa, Artificial Sequence
  Description of Artificial Sequence: Synthetic peptide
  Seed: GPDPAAAFV (INS_HUMAN)
GVDPAAAFL

SEQ ID NO: 35320 - protein, 10 aa, Artificial Sequence
  Description of Artificial Sequence: Synthetic peptide
  Seed: LWGPDPAAAF (INS_HUMAN)
LVGPDPAAAF

SEQ ID NO: 35321 - protein, 9 aa, Artificial Sequence
  Description of Artificial Sequence: Synthetic peptide
  Seed: ALWGPDPAA (INS_HUMAN)
AIWGPDPAL

SEQ ID NO: 35322 - protein, 8 aa, Artificial Sequence
  Description of Artificial Sequence: Synthetic peptide
  Seed: LWMRLLPL (INS_HUMAN)
LFMRLLPM

SEQ ID NO: 35323 - protein, 9 aa, Artificial Sequence
  Description of Artificial Sequence: Synthetic peptide
  Seed: FVNQHLCGS (INS_HUMAN)
FMNQHLCGA

SEQ ID NO: 35324 - protein, 9 aa, Artificial Sequence
  Description of Artificial Sequence: Synthetic peptide
  Seed: RLLPLLALL (INS_HUMAN)
RFLPLLALF

SEQ ID NO: 35325 - protein, 9 aa, Artificial Sequence
  Description of Artificial Sequence: Synthetic peptide
  Seed: RLLPLLALL (INS_HUMAN)
RVLPLLALY

SEQ ID NO: 35326 - protein, 10 aa, Artificial Sequence
  Description of Artificial Sequence: Synthetic peptide
  Seed: REAEDLQVGQ (INS_HUMAN)
REAEDLQVGY

SEQ ID NO: 35327 - protein, 10 aa, Artificial Sequence
  Description of Artificial Sequence: Synthetic peptide
  Seed: WMRLLPLLAL (INS_HUMAN)
WMRLLPLLAK

SEQ ID NO: 35328 - protein, 10 aa, Artificial Sequence
  Description of Artificial Sequence: Synthetic peptide
  Seed: RGFFYTPKTR (INS_HUMAN)
RVFFYTPKTK

SEQ ID NO: 35329 - protein, 10 aa, Artificial Sequence
  Description of Artificial Sequence: Synthetic peptide
  Seed: GPGAGSLQPL (INS_HUMAN)
GPGAGSLQPM

SEQ ID NO: 35330 - protein, 9 aa, Artificial Sequence
  Description of Artificial Sequence: Synthetic peptide
  Seed: FFYTPKTRR (INS_HUMAN)
FVYTPKTRR

SEQ ID NO: 35331 - protein, 10 aa, Artificial Sequence
  Description of Artificial Sequence: Synthetic peptide
  Seed: VNQHLCGSHL (INS_HUMAN)
VVQHLCGSHY

SEQ ID NO: 35332 - protein, 10 aa, Artificial Sequence
  Description of Artificial Sequence: Synthetic peptide
  Seed: ALWMRLLPLL (INS_HUMAN)
AQWMRLLPLI

SEQ ID NO: 35333 - protein, 10 aa, Artificial Sequence
  Description of Artificial Sequence: Synthetic peptide
  Seed: MRLLPLLALL (INS_HUMAN)
MHLLPLLALI

SEQ ID NO: 35334 - protein, 10 aa, Artificial Sequence
  Description of Artificial Sequence: Synthetic peptide
  Seed: YLVCGERGFF (INS_HUMAN)
YQVCGERGFY

SEQ ID NO: 35335 - protein, 9 aa, Artificial Sequence
  Description of Artificial Sequence: Synthetic peptide
  Seed: GERGFFYTP (INS_HUMAN)
GERGFFYTV

SEQ ID NO: 35336 - protein, 9 aa, Artificial Sequence
  Description of Artificial Sequence: Synthetic peptide
  Seed: ALWGPDPAA (INS_HUMAN)
AMWGPDPAI

SEQ ID NO: 35337 - protein, 10 aa, Artificial Sequence
  Description of Artificial Sequence: Synthetic peptide
  Seed: LLALWGPDPA (INS_HUMAN)
LMALWGPDPA

SEQ ID NO: 35338 - protein, 9 aa, Artificial Sequence
  Description of Artificial Sequence: Synthetic peptide
  Seed: RLLPLLALL (INS_HUMAN)
RVLPLLALR

SEQ ID NO: 35339 - protein, 9 aa, Artificial Sequence
  Description of Artificial Sequence: Synthetic peptide
  Seed: AEDLQVGQV (INS_HUMAN)
AQDLQVGQM

SEQ ID NO: 35340 - protein, 9 aa, Artificial Sequence
  Description of Artificial Sequence: Synthetic peptide
  Seed: FVNQHLCGS (INS_HUMAN)
FMNQHLCGI

SEQ ID NO: 35341 - protein, 10 aa, Artificial Sequence
  Description of Artificial Sequence: Synthetic peptide
  Seed: AEDLQVGQVE (INS_HUMAN)
AEDLQVGQVC

SEQ ID NO: 35342 - protein, 9 aa, Artificial Sequence
  Description of Artificial Sequence: Synthetic peptide
  Seed: GPDPAAAFV (INS_HUMAN)
GVDPAAAFV

SEQ ID NO: 35343 - protein, 10 aa, Artificial Sequence
  Description of Artificial Sequence: Synthetic peptide
  Seed: HLVEALYLVC (INS_HUMAN)
HQVEALYLVL

SEQ ID NO: 35344 - protein, 10 aa, Artificial Sequence
  Description of Artificial Sequence: Synthetic peptide
  Seed: MALWMRLLPL (INS_HUMAN)
MSLWMRLLPA

SEQ ID NO: 35345 - protein, 9 aa, Artificial Sequence
  Description of Artificial Sequence: Synthetic peptide
  Seed: NQHLCGSHL (INS_HUMAN)
NMHLCGSHY

SEQ ID NO: 35346 - protein, 10 aa, Artificial Sequence
  Description of Artificial Sequence: Synthetic peptide
  Seed: WMRLLPLLAL (INS_HUMAN)
WPRLLPLLAM

SEQ ID NO: 35347 - protein, 10 aa, Artificial Sequence
  Description of Artificial Sequence: Synthetic peptide
  Seed: VNQHLCGSHL (INS_HUMAN)
VKQHLCGSHF

SEQ ID NO: 35348 - protein, 10 aa, Artificial Sequence
  Description of Artificial Sequence: Synthetic peptide
  Seed: WMRLLPLLAL (INS_HUMAN)
WNRLLPLLAM

SEQ ID NO: 35349 - protein, 10 aa, Artificial Sequence
  Description of Artificial Sequence: Synthetic peptide
  Seed: SHLVEALYLV (INS_HUMAN)
SYLVEALYLT

SEQ ID NO: 35350 - protein, 11 aa, Artificial Sequence
  Description of Artificial Sequence: Synthetic peptide
  Seed: SHLVEALYLVC (INS_HUMAN)
SFLVEALYLVV

SEQ ID NO: 35351 - protein, 11 aa, Artificial Sequence
  Description of Artificial Sequence: Synthetic peptide
  Seed: WMRLLPLLALL (INS_HUMAN)
WYRLLPLLALI

SEQ ID NO: 35352 - protein, 10 aa, Artificial Sequence
  Description of Artificial Sequence: Synthetic peptide
  Seed: WMRLLPLLAL (INS_HUMAN)
WLRLLPLLAK

SEQ ID NO: 35353 - protein, 10 aa, Artificial Sequence
  Description of Artificial Sequence: Synthetic peptide
  Seed: MRLLPLLALL (INS_HUMAN)
MDLLPLLALL

SEQ ID NO: 35354 - protein, 9 aa, Artificial Sequence
  Description of Artificial Sequence: Synthetic peptide
  Seed: AEDLQVGQV (INS_HUMAN)
AIDLQVGQV

SEQ ID NO: 35355 - protein, 9 aa, Artificial Sequence
  Description of Artificial Sequence: Synthetic peptide
  Seed: QHLCGSHLV (INS_HUMAN)
QHLCGSHLM

SEQ ID NO: 35356 - protein, 10 aa, Artificial Sequence
  Description of Artificial Sequence: Synthetic peptide
  Seed: MALWMRLLPL (INS_HUMAN)
MTLWMRLLPF

SEQ ID NO: 35357 - protein, 10 aa, Artificial Sequence
  Description of Artificial Sequence: Synthetic peptide
  Seed: LLPLLALLAL (INS_HUMAN)
LLPLLALLAY

SEQ ID NO: 35358 - protein, 11 aa, Artificial Sequence
  Description of Artificial Sequence: Synthetic peptide
  Seed: ALWGPDPAAAF (INS_HUMAN)
AAWGPDPAAAW

SEQ ID NO: 35359 - protein, 9 aa, Artificial Sequence
  Description of Artificial Sequence: Synthetic peptide
  Seed: LWMRLLPLL (INS_HUMAN)
LMMRLLPLF

SEQ ID NO: 35360 - protein, 10 aa, Artificial Sequence
  Description of Artificial Sequence: Synthetic peptide
  Seed: MALWMRLLPL (INS_HUMAN)
MCLWMRLLPY

SEQ ID NO: 35361 - protein, 10 aa, Artificial Sequence
  Description of Artificial Sequence: Synthetic peptide
  Seed: MALWMRLLPL (INS_HUMAN)
MSLWMRLLPI

SEQ ID NO: 35362 - protein, 9 aa, Artificial Sequence
  Description of Artificial Sequence: Synthetic peptide
  Seed: SLYQLENYC (INS_HUMAN)
SQYQLENYV

SEQ ID NO: 35363 - protein, 9 aa, Artificial Sequence
  Description of Artificial Sequence: Synthetic peptide
  Seed: LALWGPDPA (INS_HUMAN)
LLLWGPDPV

SEQ ID NO: 35364 - protein, 10 aa, Artificial Sequence
  Description of Artificial Sequence: Synthetic peptide
  Seed: REAEDLQVGQ (INS_HUMAN)
REAEDLQVGP

SEQ ID NO: 35365 - protein, 10 aa, Artificial Sequence
  Description of Artificial Sequence: Synthetic peptide
  Seed: SHLVEALYLV (INS_HUMAN)
SFLVEALYLI

SEQ ID NO: 35366 - protein, 9 aa, Artificial Sequence
  Description of Artificial Sequence: Synthetic peptide
  Seed: ALWMRLLPL (INS_HUMAN)
AAWMRLLPL

SEQ ID NO: 35367 - protein, 10 aa, Artificial Sequence
  Description of Artificial Sequence: Synthetic peptide
  Seed: MRLLPLLALL (INS_HUMAN)
MHLLPLLALM

SEQ ID NO: 35368 - protein, 9 aa, Artificial Sequence
  Description of Artificial Sequence: Synthetic peptide
  Seed: HLVEALYLV (INS_HUMAN)
HMVEALYLR

SEQ ID NO: 35369 - protein, 9 aa, Artificial Sequence
  Description of Artificial Sequence: Synthetic peptide
  Seed: RLLPLLALL (INS_HUMAN)
RVLPLLALI

SEQ ID NO: 35370 - protein, 10 aa, Artificial Sequence
  Description of Artificial Sequence: Synthetic peptide
  Seed: RLLPLLALLA (INS_HUMAN)
RLLPLLALLF

SEQ ID NO: 35371 - protein, 11 aa, Artificial Sequence
  Description of Artificial Sequence: Synthetic peptide
  Seed: GSHLVEALYLV (INS_HUMAN)
GVHLVEALYLL

SEQ ID NO: 35372 - protein, 9 aa, Artificial Sequence
  Description of Artificial Sequence: Synthetic peptide
  Seed: AAFVNQHLC (INS_HUMAN)
ASFVNQHLL

SEQ ID NO: 35373 - protein, 9 aa, Artificial Sequence
  Description of Artificial Sequence: Synthetic peptide
  Seed: RLLPLLALL (INS_HUMAN)
RALPLLALW

SEQ ID NO: 35374 - protein, 10 aa, Artificial Sequence
  Description of Artificial Sequence: Synthetic peptide
  Seed: WMRLLPLLAL (INS_HUMAN)
WMRLLPLLAI

SEQ ID NO: 35375 - protein, 10 aa, Artificial Sequence
  Description of Artificial Sequence: Synthetic peptide
  Seed: MALWMRLLPL (INS_HUMAN)
MQLWMRLLPA

SEQ ID NO: 35376 - protein, 9 aa, Artificial Sequence
  Description of Artificial Sequence: Synthetic peptide
  Seed: REAEDLQVG (INS_HUMAN)
REAEDLQVI

SEQ ID NO: 35377 - protein, 10 aa, Artificial Sequence
  Description of Artificial Sequence: Synthetic peptide
  Seed: LWGPDPAAAF (INS_HUMAN)
LFGPDPAAAM

SEQ ID NO: 35378 - protein, 10 aa, Artificial Sequence
  Description of Artificial Sequence: Synthetic peptide
  Seed: MALWMRLLPL (INS_HUMAN)
MILWMRLLPV

SEQ ID NO: 35379 - protein, 10 aa, Artificial Sequence
  Description of Artificial Sequence: Synthetic peptide
  Seed: RGFFYTPKTR (INS_HUMAN)
RRFFYTPKTR

SEQ ID NO: 35380 - protein, 9 aa, Artificial Sequence
  Description of Artificial Sequence: Synthetic peptide
  Seed: AAFVNQHLC (INS_HUMAN)
AIFVNQHLW

SEQ ID NO: 35381 - protein, 9 aa, Artificial Sequence
  Description of Artificial Sequence: Synthetic peptide
  Seed: YTPKTRREA (INS_HUMAN)
YGPKTRREM

SEQ ID NO: 35382 - protein, 10 aa, Artificial Sequence
  Description of Artificial Sequence: Synthetic peptide
  Seed: LLALWGPDPA (INS_HUMAN)
LLALWGPDPL

SEQ ID NO: 35383 - protein, 11 aa, Artificial Sequence
  Description of Artificial Sequence: Synthetic peptide
  Seed: SLQPLALEGSL (INS_HUMAN)
SLQPLALEGSV

SEQ ID NO: 35384 - protein, 9 aa, Artificial Sequence
  Description of Artificial Sequence: Synthetic peptide
  Seed: ALWMRLLPL (INS_HUMAN)
AVWMRLLPW

SEQ ID NO: 35385 - protein, 11 aa, Artificial Sequence
  Description of Artificial Sequence: Synthetic peptide
  Seed: REAEDLQVGQV (INS_HUMAN)
RQAEDLQVGQW

SEQ ID NO: 35386 - protein, 11 aa, Artificial Sequence
  Description of Artificial Sequence: Synthetic peptide
  Seed: ALWGPDPAAAF (INS_HUMAN)
ARWGPDPAAAM

SEQ ID NO: 35387 - protein, 10 aa, Artificial Sequence
  Description of Artificial Sequence: Synthetic peptide
  Seed: ALWMRLLPLL (INS_HUMAN)
AKWMRLLPLF

SEQ ID NO: 35388 - protein, 9 aa, Artificial Sequence
  Description of Artificial Sequence: Synthetic peptide
  Seed: AGSLQPLAL (INS_HUMAN)
ASSLQPLAM

SEQ ID NO: 35389 - protein, 11 aa, Artificial Sequence
  Description of Artificial Sequence: Synthetic peptide
  Seed: ALWGPDPAAAF (INS_HUMAN)
ALWGPDPAAAW

SEQ ID NO: 35390 - protein, 9 aa, Artificial Sequence
  Description of Artificial Sequence: Synthetic peptide
  Seed: RLLPLLALL (INS_HUMAN)
RFLPLLALY

SEQ ID NO: 35391 - protein, 10 aa, Artificial Sequence
  Description of Artificial Sequence: Synthetic peptide
  Seed: LWMRLLPLLA (INS_HUMAN)
LLMRLLPLLL

SEQ ID NO: 35392 - protein, 9 aa, Artificial Sequence
  Description of Artificial Sequence: Synthetic peptide
  Seed: ALWMRLLPL (INS_HUMAN)
AMWMRLLPV

SEQ ID NO: 35393 - protein, 10 aa, Artificial Sequence
  Description of Artificial Sequence: Synthetic peptide
  Seed: WMRLLPLLAL (INS_HUMAN)
WCRLLPLLAM

SEQ ID NO: 35394 - protein, 9 aa, Artificial Sequence
  Description of Artificial Sequence: Synthetic peptide
  Seed: SHLVEALYL (INS_HUMAN)
SHLVEALYA

SEQ ID NO: 35395 - protein, 10 aa, Artificial Sequence
  Description of Artificial Sequence: Synthetic peptide
  Seed: MALWMRLLPL (INS_HUMAN)
MKLWMRLLPM

SEQ ID NO: 35396 - protein, 9 aa, Artificial Sequence
  Description of Artificial Sequence: Synthetic peptide
  Seed: WGPDPAAAF (INS_HUMAN)
WYPDPAAAY

SEQ ID NO: 35397 - protein, 10 aa, Artificial Sequence
  Description of Artificial Sequence: Synthetic peptide
  Seed: SHLVEALYLV (INS_HUMAN)
SNLVEALYLL

SEQ ID NO: 35398 - protein, 10 aa, Artificial Sequence
  Description of Artificial Sequence: Synthetic peptide
  Seed: HLCGSHLVEA (INS_HUMAN)
HLCGSHLVEM

SEQ ID NO: 35399 - protein, 9 aa, Artificial Sequence
  Description of Artificial Sequence: Synthetic peptide
  Seed: ALWMRLLPL (INS_HUMAN)
APWMRLLPL

SEQ ID NO: 35400 - protein, 10 aa, Artificial Sequence
  Description of Artificial Sequence: Synthetic peptide
  Seed: ALWMRLLPLL (INS_HUMAN)
AMWMRLLPLM

SEQ ID NO: 35401 - protein, 9 aa, Artificial Sequence
  Description of Artificial Sequence: Synthetic peptide
  Seed: TSICSLYQL (INS_HUMAN)
TIICSLYQA

SEQ ID NO: 35402 - protein, 9 aa, Artificial Sequence
  Description of Artificial Sequence: Synthetic peptide
  Seed: MALWMRLLP (INS_HUMAN)
MPLWMRLLA

SEQ ID NO: 35403 - protein, 10 aa, Artificial Sequence
  Description of Artificial Sequence: Synthetic peptide
  Seed: SHLVEALYLV (INS_HUMAN)
SLLVEALYLA

SEQ ID NO: 35404 - protein, 9 aa, Artificial Sequence
  Description of Artificial Sequence: Synthetic peptide
  Seed: RLLPLLALL (INS_HUMAN)
RRLPLLALV

SEQ ID NO: 35405 - protein, 10 aa, Artificial Sequence
  Description of Artificial Sequence: Synthetic peptide
  Seed: ALWMRLLPLL (INS_HUMAN)
AMWMRLLPLI

SEQ ID NO: 35406 - protein, 9 aa, Artificial Sequence
  Description of Artificial Sequence: Synthetic peptide
  Seed: ALWMRLLPL (INS_HUMAN)
ATWMRLLPM

SEQ ID NO: 35407 - protein, 9 aa, Artificial Sequence
  Description of Artificial Sequence: Synthetic peptide
  Seed: RLLPLLALL (INS_HUMAN)
RMLPLLALW

SEQ ID NO: 35408 - protein, 9 aa, Artificial Sequence
  Description of Artificial Sequence: Synthetic peptide
  Seed: GSHLVEALY (INS_HUMAN)
GQHLVEALY

SEQ ID NO: 35409 - protein, 10 aa, Artificial Sequence
  Description of Artificial Sequence: Synthetic peptide
  Seed: HLVEALYLVC (INS_HUMAN)
HLVEALYLVT

SEQ ID NO: 35410 - protein, 10 aa, Artificial Sequence
  Description of Artificial Sequence: Synthetic peptide
  Seed: SHLVEALYLV (INS_HUMAN)
SGLVEALYLL

SEQ ID NO: 35411 - protein, 9 aa, Artificial Sequence
  Description of Artificial Sequence: Synthetic peptide
  Seed: AGSLQPLAL (INS_HUMAN)
AASLQPLAI

SEQ ID NO: 35412 - protein, 9 aa, Artificial Sequence
  Description of Artificial Sequence: Synthetic peptide
  Seed: ALWGPDPAA (INS_HUMAN)
AVWGPDPAV

SEQ ID NO: 35413 - protein, 11 aa, Artificial Sequence
  Description of Artificial Sequence: Synthetic peptide
  Seed: WMRLLPLLALL (INS_HUMAN)
WLRLLPLLALL

SEQ ID NO: 35414 - protein, 11 aa, Artificial Sequence
  Description of Artificial Sequence: Synthetic peptide
  Seed: ALWMRLLPLLA (INS_HUMAN)
ALWMRLLPLLV

SEQ ID NO: 35415 - protein, 9 aa, Artificial Sequence
  Description of Artificial Sequence: Synthetic peptide
  Seed: AGSLQPLAL (INS_HUMAN)
ATSLQPLAY

SEQ ID NO: 35416 - protein, 10 aa, Artificial Sequence
  Description of Artificial Sequence: Synthetic peptide
  Seed: MRLLPLLALL (INS_HUMAN)
MALLPLLALA

SEQ ID NO: 35417 - protein, 10 aa, Artificial Sequence
  Description of Artificial Sequence: Synthetic peptide
  Seed: RLLPLLALLA (INS_HUMAN)
RLLPLLALLN

SEQ ID NO: 35418 - protein, 8 aa, Artificial Sequence
  Description of Artificial Sequence: Synthetic peptide
  Seed: GPDPAAAF (INS_HUMAN)
GSDPAAAV

SEQ ID NO: 35419 - protein, 10 aa, Artificial Sequence
  Description of Artificial Sequence: Synthetic peptide
  Seed: SHLVEALYLV (INS_HUMAN)
SCLVEALYLL

SEQ ID NO: 35420 - protein, 9 aa, Artificial Sequence
  Description of Artificial Sequence: Synthetic peptide
  Seed: LALEGSLQK (INS_HUMAN)
LSLEGSLQM

SEQ ID NO: 35421 - protein, 11 aa, Artificial Sequence
  Description of Artificial Sequence: Synthetic peptide
  Seed: REAEDLQVGQV (INS_HUMAN)
RMAEDLQVGQM

SEQ ID NO: 35422 - protein, 9 aa, Artificial Sequence
  Description of Artificial Sequence: Synthetic peptide
  Seed: LWMRLLPLL (INS_HUMAN)
LWMRLLPLI

SEQ ID NO: 35423 - protein, 11 aa, Artificial Sequence
  Description of Artificial Sequence: Synthetic peptide
  Seed: WMRLLPLLALL (INS_HUMAN)
WNRLLPLLALV

SEQ ID NO: 35424 - protein, 9 aa, Artificial Sequence
  Description of Artificial Sequence: Synthetic peptide
  Seed: AGSLQPLAL (INS_HUMAN)
AQSLQPLAF

SEQ ID NO: 35425 - protein, 10 aa, Artificial Sequence
  Description of Artificial Sequence: Synthetic peptide
  Seed: WMRLLPLLAL (INS_HUMAN)
WQRLLPLLAL

SEQ ID NO: 35426 - protein, 9 aa, Artificial Sequence
  Description of Artificial Sequence: Synthetic peptide
  Seed: RLLPLLALL (INS_HUMAN)
RTLPLLALF

SEQ ID NO: 35427 - protein, 10 aa, Artificial Sequence
  Description of Artificial Sequence: Synthetic peptide
  Seed: MRLLPLLALL (INS_HUMAN)
MRLLPLLALK

SEQ ID NO: 35428 - protein, 9 aa, Artificial Sequence
  Description of Artificial Sequence: Synthetic peptide
  Seed: RLLPLLALL (INS_HUMAN)
RKLPLLALI

SEQ ID NO: 35429 - protein, 11 aa, Artificial Sequence
  Description of Artificial Sequence: Synthetic peptide
  Seed: KTRREAEDLQV (INS_HUMAN)
KSRREAEDLQW

SEQ ID NO: 35430 - protein, 9 aa, Artificial Sequence
  Description of Artificial Sequence: Synthetic peptide
  Seed: MRLLPLLAL (INS_HUMAN)
MMLLPLLAF

SEQ ID NO: 35431 - protein, 10 aa, Artificial Sequence
  Description of Artificial Sequence: Synthetic peptide
  Seed: MRLLPLLALL (INS_HUMAN)
MQLLPLLALA

SEQ ID NO: 35432 - protein, 10 aa, Artificial Sequence
  Description of Artificial Sequence: Synthetic peptide
  Seed: LWMRLLPLLA (INS_HUMAN)
LQMRLLPLLV

SEQ ID NO: 35433 - protein, 9 aa, Artificial Sequence
  Description of Artificial Sequence: Synthetic peptide
  Seed: LWMRLLPLL (INS_HUMAN)
LWMRLLPLM

SEQ ID NO: 35434 - protein, 11 aa, Artificial Sequence
  Description of Artificial Sequence: Synthetic peptide
  Seed: SHLVEALYLVC (INS_HUMAN)
SLLVEALYLVR

SEQ ID NO: 35435 - protein, 10 aa, Artificial Sequence
  Description of Artificial Sequence: Synthetic peptide
  Seed: WMRLLPLLAL (INS_HUMAN)
WVRLLPLLAK

SEQ ID NO: 35436 - protein, 9 aa, Artificial Sequence
  Description of Artificial Sequence: Synthetic peptide
  Seed: RLLPLLALL (INS_HUMAN)
RTLPLLALV

SEQ ID NO: 35437 - protein, 9 aa, Artificial Sequence
  Description of Artificial Sequence: Synthetic peptide
  Seed: WGPDPAAAF (INS_HUMAN)
WVPDPAAAF

SEQ ID NO: 35438 - protein, 10 aa, Artificial Sequence
  Description of Artificial Sequence: Synthetic peptide
  Seed: WMRLLPLLAL (INS_HUMAN)
WLRLLPLLAV

SEQ ID NO: 35439 - protein, 9 aa, Artificial Sequence
  Description of Artificial Sequence: Synthetic peptide
  Seed: HLVEALYLV (INS_HUMAN)
HIVEALYLI

SEQ ID NO: 35440 - protein, 11 aa, Artificial Sequence
  Description of Artificial Sequence: Synthetic peptide
  Seed: GQVELGGGPGA (INS_HUMAN)
GEVELGGGPGM

SEQ ID NO: 35441 - protein, 9 aa, Artificial Sequence
  Description of Artificial Sequence: Synthetic peptide
  Seed: WGPDPAAAF (INS_HUMAN)
WMPDPAAAI

SEQ ID NO: 35442 - protein, 10 aa, Artificial Sequence
  Description of Artificial Sequence: Synthetic peptide
  Seed: RGFFYTPKTR (INS_HUMAN)
RPFFYTPKTR

SEQ ID NO: 35443 - protein, 9 aa, Artificial Sequence
  Description of Artificial Sequence: Synthetic peptide
  Seed: GPDPAAAFV (INS_HUMAN)
GMDPAAAFV

SEQ ID NO: 35444 - protein, 9 aa, Artificial Sequence
  Description of Artificial Sequence: Synthetic peptide
  Seed: REAEDLQVG (INS_HUMAN)
REAEDLQVC

SEQ ID NO: 35445 - protein, 10 aa, Artificial Sequence
  Description of Artificial Sequence: Synthetic peptide
  Seed: ALWGPDPAAA (INS_HUMAN)
ALWGPDPAAL

SEQ ID NO: 35446 - protein, 11 aa, Artificial Sequence
  Description of Artificial Sequence: Synthetic peptide
  Seed: GSHLVEALYLV (INS_HUMAN)
GLHLVEALYLI

SEQ ID NO: 35447 - protein, 9 aa, Artificial Sequence
  Description of Artificial Sequence: Synthetic peptide
  Seed: FVNQHLCGS (INS_HUMAN)
FLNQHLCGV

SEQ ID NO: 35448 - protein, 9 aa, Artificial Sequence
  Description of Artificial Sequence: Synthetic peptide
  Seed: AEDLQVGQV (INS_HUMAN)
ATDLQVGQF

SEQ ID NO: 35449 - protein, 10 aa, Artificial Sequence
  Description of Artificial Sequence: Synthetic peptide
  Seed: WMRLLPLLAL (INS_HUMAN)
WQRLLPLLAV

SEQ ID NO: 35450 - protein, 10 aa, Artificial Sequence
  Description of Artificial Sequence: Synthetic peptide
  Seed: HLVEALYLVC (INS_HUMAN)
HLVEALYLVL

SEQ ID NO: 35451 - protein, 11 aa, Artificial Sequence
  Description of Artificial Sequence: Synthetic peptide
  Seed: ALWGPDPAAAF (INS_HUMAN)
AYWGPDPAAAM

SEQ ID NO: 35452 - protein, 10 aa, Artificial Sequence
  Description of Artificial Sequence: Synthetic peptide
  Seed: SHLVEALYLV (INS_HUMAN)
SALVEALYLA

SEQ ID NO: 35453 - protein, 10 aa, Artificial Sequence
  Description of Artificial Sequence: Synthetic peptide
  Seed: MALWMRLLPL (INS_HUMAN)
MALWMRLLPF

SEQ ID NO: 35454 - protein, 9 aa, Artificial Sequence
  Description of Artificial Sequence: Synthetic peptide
  Seed: LALWGPDPA (INS_HUMAN)
LLLWGPDPM

SEQ ID NO: 35455 - protein, 9 aa, Artificial Sequence
  Description of Artificial Sequence: Synthetic peptide
  Seed: AEDLQVGQV (INS_HUMAN)
ALDLQVGQF

SEQ ID NO: 35456 - protein, 10 aa, Artificial Sequence
  Description of Artificial Sequence: Synthetic peptide
  Seed: GIVEQCCTSI (INS_HUMAN)
GLVEQCCTSL

SEQ ID NO: 35457 - protein, 10 aa, Artificial Sequence
  Description of Artificial Sequence: Synthetic peptide
  Seed: MALWMRLLPL (INS_HUMAN)
MGLWMRLLPM

SEQ ID NO: 35458 - protein, 11 aa, Artificial Sequence
  Description of Artificial Sequence: Synthetic peptide
  Seed: SHLVEALYLVC (INS_HUMAN)
SMLVEALYLVA

SEQ ID NO: 35459 - protein, 9 aa, Artificial Sequence
  Description of Artificial Sequence: Synthetic peptide
  Seed: ALWGPDPAA (INS_HUMAN)
AQWGPDPAV

SEQ ID NO: 35460 - protein, 9 aa, Artificial Sequence
  Description of Artificial Sequence: Synthetic peptide
  Seed: LALEGSLQK (INS_HUMAN)
LTLEGSLQR

SEQ ID NO: 35461 - protein, 11 aa, Artificial Sequence
  Description of Artificial Sequence: Synthetic peptide
  Seed: ALWGPDPAAAF (INS_HUMAN)
ALWGPDPAAAL

SEQ ID NO: 35462 - protein, 10 aa, Artificial Sequence
  Description of Artificial Sequence: Synthetic peptide
  Seed: LALWGPDPAA (INS_HUMAN)
LVLWGPDPAV

SEQ ID NO: 35463 - protein, 10 aa, Artificial Sequence
  Description of Artificial Sequence: Synthetic peptide
  Seed: VNQHLCGSHL (INS_HUMAN)
VQQHLCGSHM

SEQ ID NO: 35464 - protein, 9 aa, Artificial Sequence
  Description of Artificial Sequence: Synthetic peptide
  Seed: GPDPAAAFV (INS_HUMAN)
GIDPAAAFF

SEQ ID NO: 35465 - protein, 10 aa, Artificial Sequence
  Description of Artificial Sequence: Synthetic peptide
  Seed: ALWMRLLPLL (INS_HUMAN)
AQWMRLLPLL

SEQ ID NO: 35466 - protein, 9 aa, Artificial Sequence
  Description of Artificial Sequence: Synthetic peptide
  Seed: ALWMRLLPL (INS_HUMAN)
AVWMRLLPI

SEQ ID NO: 35467 - protein, 9 aa, Artificial Sequence
  Description of Artificial Sequence: Synthetic peptide
  Seed: LPLLALLAL (INS_HUMAN)
LPLLALLAP

SEQ ID NO: 35468 - protein, 9 aa, Artificial Sequence
  Description of Artificial Sequence: Synthetic peptide
  Seed: RLLPLLALL (INS_HUMAN)
RQLPLLALK

SEQ ID NO: 35469 - protein, 10 aa, Artificial Sequence
  Description of Artificial Sequence: Synthetic peptide
  Seed: LALWGPDPAA (INS_HUMAN)
LILWGPDPAI

SEQ ID NO: 35470 - protein, 10 aa, Artificial Sequence
  Description of Artificial Sequence: Synthetic peptide
  Seed: WMRLLPLLAL (INS_HUMAN)
WERLLPLLAL

SEQ ID NO: 35471 - protein, 9 aa, Artificial Sequence
  Description of Artificial Sequence: Synthetic peptide
  Seed: LPLLALLAL (INS_HUMAN)
LPLLALLAY

SEQ ID NO: 35472 - protein, 10 aa, Artificial Sequence
  Description of Artificial Sequence: Synthetic peptide
  Seed: MALWMRLLPL (INS_HUMAN)
MILWMRLLPL

SEQ ID NO: 35473 - protein, 11 aa, Artificial Sequence
  Description of Artificial Sequence: Synthetic peptide
  Seed: ALWGPDPAAAF (INS_HUMAN)
AAWGPDPAAAY

SEQ ID NO: 35474 - protein, 9 aa, Artificial Sequence
  Description of Artificial Sequence: Synthetic peptide
  Seed: MRLLPLLAL (INS_HUMAN)
MHLLPLLAL

SEQ ID NO: 35475 - protein, 11 aa, Artificial Sequence
  Description of Artificial Sequence: Synthetic peptide
  Seed: ALWGPDPAAAF (INS_HUMAN)
AAWGPDPAAAF

SEQ ID NO: 35476 - protein, 10 aa, Artificial Sequence
  Description of Artificial Sequence: Synthetic peptide
  Seed: MALWMRLLPL (INS_HUMAN)
MTLWMRLLPW

SEQ ID NO: 35477 - protein, 10 aa, Artificial Sequence
  Description of Artificial Sequence: Synthetic peptide
  Seed: RGFFYTPKTR (INS_HUMAN)
RKFFYTPKTR

SEQ ID NO: 35478 - protein, 9 aa, Artificial Sequence
  Description of Artificial Sequence: Synthetic peptide
  Seed: TSICSLYQL (INS_HUMAN)
TVICSLYQI

SEQ ID NO: 35479 - protein, 11 aa, Artificial Sequence
  Description of Artificial Sequence: Synthetic peptide
  Seed: GSHLVEALYLV (INS_HUMAN)
GWHLVEALYLV

SEQ ID NO: 35480 - protein, 8 aa, Artificial Sequence
  Description of Artificial Sequence: Synthetic peptide
  Seed: RGFFYTPK (INS_HUMAN)
RLFFYTPR

SEQ ID NO: 35481 - protein, 9 aa, Artificial Sequence
  Description of Artificial Sequence: Synthetic peptide
  Seed: ALWMRLLPL (INS_HUMAN)
AMWMRLLPT

SEQ ID NO: 35482 - protein, 9 aa, Artificial Sequence
  Description of Artificial Sequence: Synthetic peptide
  Seed: YLVCGERGF (INS_HUMAN)
YSVCGERGF

SEQ ID NO: 35483 - protein, 10 aa, Artificial Sequence
  Description of Artificial Sequence: Synthetic peptide
  Seed: MALWMRLLPL (INS_HUMAN)
MGLWMRLLPI

SEQ ID NO: 35484 - protein, 10 aa, Artificial Sequence
  Description of Artificial Sequence: Synthetic peptide
  Seed: WMRLLPLLAL (INS_HUMAN)
WPRLLPLLAF

SEQ ID NO: 35485 - protein, 9 aa, Artificial Sequence
  Description of Artificial Sequence: Synthetic peptide
  Seed: DLQVGQVEL (INS_HUMAN)
DLQVGQVEY

SEQ ID NO: 35486 - protein, 9 aa, Artificial Sequence
  Description of Artificial Sequence: Synthetic peptide
  Seed: RLLPLLALL (INS_HUMAN)
RRLPLLALY

SEQ ID NO: 35487 - protein, 9 aa, Artificial Sequence
  Description of Artificial Sequence: Synthetic peptide
  Seed: ALYLVCGER (INS_HUMAN)
ATYLVCGEK

SEQ ID NO: 35488 - protein, 11 aa, Artificial Sequence
  Description of Artificial Sequence: Synthetic peptide
  Seed: MALWMRLLPLL (INS_HUMAN)
MMLWMRLLPLL

SEQ ID NO: 35489 - protein, 10 aa, Artificial Sequence
  Description of Artificial Sequence: Synthetic peptide
  Seed: SHLVEALYLV (INS_HUMAN)
SSLVEALYLV

SEQ ID NO: 35490 - protein, 9 aa, Artificial Sequence
  Description of Artificial Sequence: Synthetic peptide
  Seed: ALWMRLLPL (INS_HUMAN)
ASWMRLLPF

SEQ ID NO: 35491 - protein, 10 aa, Artificial Sequence
  Description of Artificial Sequence: Synthetic peptide
  Seed: HLVEALYLVC (INS_HUMAN)
HLVEALYLVG

SEQ ID NO: 35492 - protein, 11 aa, Artificial Sequence
  Description of Artificial Sequence: Synthetic peptide
  Seed: GSHLVEALYLV (INS_HUMAN)
GHHLVEALYLL

SEQ ID NO: 35493 - protein, 9 aa, Artificial Sequence
  Description of Artificial Sequence: Synthetic peptide
  Seed: LPLLALLAL (INS_HUMAN)
LPLLALLAV

SEQ ID NO: 35494 - protein, 9 aa, Artificial Sequence
  Description of Artificial Sequence: Synthetic peptide
  Seed: LALWGPDPA (INS_HUMAN)
LVLWGPDPV

SEQ ID NO: 35495 - protein, 10 aa, Artificial Sequence
  Description of Artificial Sequence: Synthetic peptide
  Seed: LALWGPDPAA (INS_HUMAN)
LALWGPDPAV

SEQ ID NO: 35496 - protein, 9 aa, Artificial Sequence
  Description of Artificial Sequence: Synthetic peptide
  Seed: FVNQHLCGS (INS_HUMAN)
FSNQHLCGA

SEQ ID NO: 35497 - protein, 9 aa, Artificial Sequence
  Description of Artificial Sequence: Synthetic peptide
  Seed: WGPDPAAAF (INS_HUMAN)
WMPDPAAAL

SEQ ID NO: 35498 - protein, 10 aa, Artificial Sequence
  Description of Artificial Sequence: Synthetic peptide
  Seed: HLVEALYLVC (INS_HUMAN)
HMVEALYLVL

SEQ ID NO: 35499 - protein, 10 aa, Artificial Sequence
  Description of Artificial Sequence: Synthetic peptide
  Seed: HLVEALYLVC (INS_HUMAN)
HLVEALYLVA

SEQ ID NO: 35500 - protein, 10 aa, Artificial Sequence
  Description of Artificial Sequence: Synthetic peptide
  Seed: SHLVEALYLV (INS_HUMAN)
SSLVEALYLA

SEQ ID NO: 35501 - protein, 9 aa, Artificial Sequence
  Description of Artificial Sequence: Synthetic peptide
  Seed: MRLLPLLAL (INS_HUMAN)
MELLPLLAF

SEQ ID NO: 35502 - protein, 10 aa, Artificial Sequence
  Description of Artificial Sequence: Synthetic peptide
  Seed: SHLVEALYLV (INS_HUMAN)
SDLVEALYLA

SEQ ID NO: 35503 - protein, 9 aa, Artificial Sequence
  Description of Artificial Sequence: Synthetic peptide
  Seed: WGPDPAAAF (INS_HUMAN)
WTPDPAAAL

SEQ ID NO: 35504 - protein, 9 aa, Artificial Sequence
  Description of Artificial Sequence: Synthetic peptide
  Seed: CCTSICSLY (INS_HUMAN)
CTTSICSLY

SEQ ID NO: 35505 - protein, 8 aa, Artificial Sequence
  Description of Artificial Sequence: Synthetic peptide
  Seed: LVEALYLV (INS_HUMAN)
LLEALYLL

SEQ ID NO: 35506 - protein, 9 aa, Artificial Sequence
  Description of Artificial Sequence: Synthetic peptide
  Seed: GSHLVEALY (INS_HUMAN)
GKHLVEALF

SEQ ID NO: 35507 - protein, 9 aa, Artificial Sequence
  Description of Artificial Sequence: Synthetic peptide
  Seed: SLYQLENYC (INS_HUMAN)
SLYQLENYL

SEQ ID NO: 35508 - protein, 11 aa, Artificial Sequence
  Description of Artificial Sequence: Synthetic peptide
  Seed: SHLVEALYLVC (INS_HUMAN)
SMLVEALYLVL

SEQ ID NO: 35509 - protein, 10 aa, Artificial Sequence
  Description of Artificial Sequence: Synthetic peptide
  Seed: ALWGPDPAAA (INS_HUMAN)
AMWGPDPAAL

SEQ ID NO: 35510 - protein, 9 aa, Artificial Sequence
  Description of Artificial Sequence: Synthetic peptide
  Seed: AGSLQPLAL (INS_HUMAN)
ATSLQPLAF

SEQ ID NO: 35511 - protein, 10 aa, Artificial Sequence
  Description of Artificial Sequence: Synthetic peptide
  Seed: MALWMRLLPL (INS_HUMAN)
MVLWMRLLPI

SEQ ID NO: 35512 - protein, 10 aa, Artificial Sequence
  Description of Artificial Sequence: Synthetic peptide
  Seed: WMRLLPLLAL (INS_HUMAN)
WVRLLPLLAI

SEQ ID NO: 35513 - protein, 10 aa, Artificial Sequence
  Description of Artificial Sequence: Synthetic peptide
  Seed: LALWGPDPAA (INS_HUMAN)
LYLWGPDPAI

SEQ ID NO: 35514 - protein, 9 aa, Artificial Sequence
  Description of Artificial Sequence: Synthetic peptide
  Seed: WGPDPAAAF (INS_HUMAN)
WLPDPAAAY

SEQ ID NO: 35515 - protein, 9 aa, Artificial Sequence
  Description of Artificial Sequence: Synthetic peptide
  Seed: LWMRLLPLL (INS_HUMAN)
LYMRLLPLW

SEQ ID NO: 35516 - protein, 9 aa, Artificial Sequence
  Description of Artificial Sequence: Synthetic peptide
  Seed: REAEDLQVG (INS_HUMAN)
REAEDLQVS

SEQ ID NO: 35517 - protein, 9 aa, Artificial Sequence
  Description of Artificial Sequence: Synthetic peptide
  Seed: FVNQHLCGS (INS_HUMAN)
FINQHLCGV

SEQ ID NO: 35518 - protein, 9 aa, Artificial Sequence
  Description of Artificial Sequence: Synthetic peptide
  Seed: MRLLPLLAL (INS_HUMAN)
MYLLPLLAM

SEQ ID NO: 35519 - protein, 10 aa, Artificial Sequence
  Description of Artificial Sequence: Synthetic peptide
  Seed: LWGPDPAAAF (INS_HUMAN)
LMGPDPAAAF

SEQ ID NO: 35520 - protein, 10 aa, Artificial Sequence
  Description of Artificial Sequence: Synthetic peptide
  Seed: HLCGSHLVEA (INS_HUMAN)
HVCGSHLVEL

SEQ ID NO: 35521 - protein, 10 aa, Artificial Sequence
  Description of Artificial Sequence: Synthetic peptide
  Seed: MRLLPLLALL (INS_HUMAN)
MILLPLLALA

SEQ ID NO: 35522 - protein, 10 aa, Artificial Sequence
  Description of Artificial Sequence: Synthetic peptide
  Seed: HLVEALYLVC (INS_HUMAN)
HLVEALYLVK

SEQ ID NO: 35523 - protein, 10 aa, Artificial Sequence
  Description of Artificial Sequence: Synthetic peptide
  Seed: LLALWGPDPA (INS_HUMAN)
LLALWGPDPV

SEQ ID NO: 35524 - protein, 9 aa, Artificial Sequence
  Description of Artificial Sequence: Synthetic peptide
  Seed: MRLLPLLAL (INS_HUMAN)
MILLPLLAF

SEQ ID NO: 35525 - protein, 10 aa, Artificial Sequence
  Description of Artificial Sequence: Synthetic peptide
  Seed: WMRLLPLLAL (INS_HUMAN)
WPRLLPLLAI

SEQ ID NO: 35526 - protein, 9 aa, Artificial Sequence
  Description of Artificial Sequence: Synthetic peptide
  Seed: RLLPLLALL (INS_HUMAN)
RFLPLLALW

SEQ ID NO: 35527 - protein, 9 aa, Artificial Sequence
  Description of Artificial Sequence: Synthetic peptide
  Seed: RLLPLLALL (INS_HUMAN)
RYLPLLALV

SEQ ID NO: 35528 - protein, 9 aa, Artificial Sequence
  Description of Artificial Sequence: Synthetic peptide
  Seed: LALWGPDPA (INS_HUMAN)
LPLWGPDPV

SEQ ID NO: 35529 - protein, 9 aa, Artificial Sequence
  Description of Artificial Sequence: Synthetic peptide
  Seed: AGSLQPLAL (INS_HUMAN)
ARSLQPLAM

SEQ ID NO: 35530 - protein, 9 aa, Artificial Sequence
  Description of Artificial Sequence: Synthetic peptide
  Seed: FVNQHLCGS (INS_HUMAN)
FTNQHLCGA

SEQ ID NO: 35531 - protein, 9 aa, Artificial Sequence
  Description of Artificial Sequence: Synthetic peptide
  Seed: LALEGSLQK (INS_HUMAN)
LALEGSLQY

SEQ ID NO: 35532 - protein, 8 aa, Artificial Sequence
  Description of Artificial Sequence: Synthetic peptide
  Seed: RGFFYTPK (INS_HUMAN)
RTFFYTPK

SEQ ID NO: 35533 - protein, 9 aa, Artificial Sequence
  Description of Artificial Sequence: Synthetic peptide
  Seed: TSICSLYQL (INS_HUMAN)
TTICSLYQI

SEQ ID NO: 35534 - protein, 10 aa, Artificial Sequence
  Description of Artificial Sequence: Synthetic peptide
  Seed: WMRLLPLLAL (INS_HUMAN)
WKRLLPLLAI

SEQ ID NO: 35535 - protein, 9 aa, Artificial Sequence
  Description of Artificial Sequence: Synthetic peptide
  Seed: ALWMRLLPL (INS_HUMAN)
AGWMRLLPF

SEQ ID NO: 35536 - protein, 8 aa, Artificial Sequence
  Description of Artificial Sequence: Synthetic peptide
  Seed: GPDPAAAF (INS_HUMAN)
GVDPAAAI

SEQ ID NO: 35537 - protein, 9 aa, Artificial Sequence
  Description of Artificial Sequence: Synthetic peptide
  Seed: LPLLALLAL (INS_HUMAN)
LPLLALLAA

SEQ ID NO: 35538 - protein, 11 aa, Artificial Sequence
  Description of Artificial Sequence: Synthetic peptide
  Seed: REAEDLQVGQV (INS_HUMAN)
RLAEDLQVGQI

SEQ ID NO: 35539 - protein, 10 aa, Artificial Sequence
  Description of Artificial Sequence: Synthetic peptide
  Seed: RLLPLLALLA (INS_HUMAN)
RLLPLLALLD

SEQ ID NO: 35540 - protein, 11 aa, Artificial Sequence
  Description of Artificial Sequence: Synthetic peptide
  Seed: GSHLVEALYLV (INS_HUMAN)
GTHLVEALYLI

SEQ ID NO: 35541 - protein, 11 aa, Artificial Sequence
  Description of Artificial Sequence: Synthetic peptide
  Seed: RGFFYTPKTRR (INS_HUMAN)
REFFYTPKTRR

SEQ ID NO: 35542 - protein, 10 aa, Artificial Sequence
  Description of Artificial Sequence: Synthetic peptide
  Seed: MRLLPLLALL (INS_HUMAN)
MNLLPLLALI

SEQ ID NO: 35543 - protein, 9 aa, Artificial Sequence
  Description of Artificial Sequence: Synthetic peptide
  Seed: ALWMRLLPL (INS_HUMAN)
AQWMRLLPA

SEQ ID NO: 35544 - protein, 11 aa, Artificial Sequence
  Description of Artificial Sequence: Synthetic peptide
  Seed: ALWGPDPAAAF (INS_HUMAN)
ATWGPDPAAAR

SEQ ID NO: 35545 - protein, 11 aa, Artificial Sequence
  Description of Artificial Sequence: Synthetic peptide
  Seed: WMRLLPLLALL (INS_HUMAN)
WYRLLPLLALL

SEQ ID NO: 35546 - protein, 9 aa, Artificial Sequence
  Description of Artificial Sequence: Synthetic peptide
  Seed: WGPDPAAAF (INS_HUMAN)
WIPDPAAAY

SEQ ID NO: 35547 - protein, 8 aa, Artificial Sequence
  Description of Artificial Sequence: Synthetic peptide
  Seed: LVEALYLV (INS_HUMAN)
LNEALYLV

SEQ ID NO: 35548 - protein, 10 aa, Artificial Sequence
  Description of Artificial Sequence: Synthetic peptide
  Seed: WMRLLPLLAL (INS_HUMAN)
WPRLLPLLAL

SEQ ID NO: 35549 - protein, 10 aa, Artificial Sequence
  Description of Artificial Sequence: Synthetic peptide
  Seed: LALWGPDPAA (INS_HUMAN)
LHLWGPDPAV

SEQ ID NO: 35550 - protein, 9 aa, Artificial Sequence
  Description of Artificial Sequence: Synthetic peptide
  Seed: AGSLQPLAL (INS_HUMAN)
AVSLQPLAF

SEQ ID NO: 35551 - protein, 9 aa, Artificial Sequence
  Description of Artificial Sequence: Synthetic peptide
  Seed: LLPLLALLA (INS_HUMAN)
LLPLLALLV

SEQ ID NO: 35552 - protein, 9 aa, Artificial Sequence
  Description of Artificial Sequence: Synthetic peptide
  Seed: GPDPAAAFV (INS_HUMAN)
GTDPAAAFM

SEQ ID NO: 35553 - protein, 11 aa, Artificial Sequence
  Description of Artificial Sequence: Synthetic peptide
  Seed: SHLVEALYLVC (INS_HUMAN)
SMLVEALYLVW

SEQ ID NO: 35554 - protein, 10 aa, Artificial Sequence
  Description of Artificial Sequence: Synthetic peptide
  Seed: MALWMRLLPL (INS_HUMAN)
MRLWMRLLPA

SEQ ID NO: 35555 - protein, 11 aa, Artificial Sequence
  Description of Artificial Sequence: Synthetic peptide
  Seed: GSHLVEALYLV (INS_HUMAN)
GLHLVEALYLL

SEQ ID NO: 35556 - protein, 11 aa, Artificial Sequence
  Description of Artificial Sequence: Synthetic peptide
  Seed: ALWGPDPAAAF (INS_HUMAN)
AVWGPDPAAAW

SEQ ID NO: 35557 - protein, 9 aa, Artificial Sequence
  Description of Artificial Sequence: Synthetic peptide
  Seed: MRLLPLLAL (INS_HUMAN)
MRLLPLLAM

SEQ ID NO: 35558 - protein, 9 aa, Artificial Sequence
  Description of Artificial Sequence: Synthetic peptide
  Seed: AAAFVNQHL (INS_HUMAN)
ALAFVNQHY

SEQ ID NO: 35559 - protein, 9 aa, Artificial Sequence
  Description of Artificial Sequence: Synthetic peptide
  Seed: ALWGPDPAA (INS_HUMAN)
ATWGPDPAR

SEQ ID NO: 35560 - protein, 11 aa, Artificial Sequence
  Description of Artificial Sequence: Synthetic peptide
  Seed: GSHLVEALYLV (INS_HUMAN)
GVHLVEALYLV

SEQ ID NO: 35561 - protein, 10 aa, Artificial Sequence
  Description of Artificial Sequence: Synthetic peptide
  Seed: HLVEALYLVC (INS_HUMAN)
HLVEALYLVS

SEQ ID NO: 35562 - protein, 10 aa, Artificial Sequence
  Description of Artificial Sequence: Synthetic peptide
  Seed: MALWMRLLPL (INS_HUMAN)
MMLWMRLLPM

SEQ ID NO: 35563 - protein, 11 aa, Artificial Sequence
  Description of Artificial Sequence: Synthetic peptide
  Seed: WMRLLPLLALL (INS_HUMAN)
WTRLLPLLALV

SEQ ID NO: 35564 - protein, 9 aa, Artificial Sequence
  Description of Artificial Sequence: Synthetic peptide
  Seed: HLVEALYLV (INS_HUMAN)
HMVEALYLV

SEQ ID NO: 35565 - protein, 10 aa, Artificial Sequence
  Description of Artificial Sequence: Synthetic peptide
  Seed: MRLLPLLALL (INS_HUMAN)
MALLPLLALI

SEQ ID NO: 35566 - protein, 11 aa, Artificial Sequence
  Description of Artificial Sequence: Synthetic peptide
  Seed: SHLVEALYLVC (INS_HUMAN)
SLLVEALYLVN

SEQ ID NO: 35567 - protein, 10 aa, Artificial Sequence
  Description of Artificial Sequence: Synthetic peptide
  Seed: RLLPLLALLA (INS_HUMAN)
RLLPLLALLV

SEQ ID NO: 35568 - protein, 10 aa, Artificial Sequence
  Description of Artificial Sequence: Synthetic peptide
  Seed: LVCGERGFFY (INS_HUMAN)
LSCGERGFFW

SEQ ID NO: 35569 - protein, 9 aa, Artificial Sequence
  Description of Artificial Sequence: Synthetic peptide
  Seed: YTPKTRREA (INS_HUMAN)
YTPKTRREL

SEQ ID NO: 35570 - protein, 11 aa, Artificial Sequence
  Description of Artificial Sequence: Synthetic peptide
  Seed: HLVEALYLVCG (INS_HUMAN)
HMVEALYLVCL

SEQ ID NO: 35571 - protein, 9 aa, Artificial Sequence
  Description of Artificial Sequence: Synthetic peptide
  Seed: CGSHLVEAL (INS_HUMAN)
CASHLVEAF

SEQ ID NO: 35572 - protein, 10 aa, Artificial Sequence
  Description of Artificial Sequence: Synthetic peptide
  Seed: MALWMRLLPL (INS_HUMAN)
MELWMRLLPV

SEQ ID NO: 35573 - protein, 9 aa, Artificial Sequence
  Description of Artificial Sequence: Synthetic peptide
  Seed: NQHLCGSHL (INS_HUMAN)
NMHLCGSHM

SEQ ID NO: 35574 - protein, 9 aa, Artificial Sequence
  Description of Artificial Sequence: Synthetic peptide
  Seed: GPDPAAAFV (INS_HUMAN)
GWDPAAAFV

SEQ ID NO: 35575 - protein, 11 aa, Artificial Sequence
  Description of Artificial Sequence: Synthetic peptide
  Seed: SHLVEALYLVC (INS_HUMAN)
SLLVEALYLVW

SEQ ID NO: 35576 - protein, 10 aa, Artificial Sequence
  Description of Artificial Sequence: Synthetic peptide
  Seed: MRLLPLLALL (INS_HUMAN)
MQLLPLLALV

SEQ ID NO: 35577 - protein, 10 aa, Artificial Sequence
  Description of Artificial Sequence: Synthetic peptide
  Seed: LLALWGPDPA (INS_HUMAN)
LMALWGPDPL

SEQ ID NO: 35578 - protein, 9 aa, Artificial Sequence
  Description of Artificial Sequence: Synthetic peptide
  Seed: GPDPAAAFV (INS_HUMAN)
GWDPAAAFI

SEQ ID NO: 35579 - protein, 9 aa, Artificial Sequence
  Description of Artificial Sequence: Synthetic peptide
  Seed: MRLLPLLAL (INS_HUMAN)
MKLLPLLAY

SEQ ID NO: 35580 - protein, 9 aa, Artificial Sequence
  Description of Artificial Sequence: Synthetic peptide
  Seed: GPDPAAAFV (INS_HUMAN)
GQDPAAAFL

SEQ ID NO: 35581 - protein, 10 aa, Artificial Sequence
  Description of Artificial Sequence: Synthetic peptide
  Seed: SHLVEALYLV (INS_HUMAN)
SYLVEALYLL

SEQ ID NO: 35582 - protein, 11 aa, Artificial Sequence
  Description of Artificial Sequence: Synthetic peptide
  Seed: REAEDLQVGQV (INS_HUMAN)
REAEDLQVGQW

SEQ ID NO: 35583 - protein, 10 aa, Artificial Sequence
  Description of Artificial Sequence: Synthetic peptide
  Seed: HLVEALYLVC (INS_HUMAN)
HVVEALYLVV

SEQ ID NO: 35584 - protein, 10 aa, Artificial Sequence
  Description of Artificial Sequence: Synthetic peptide
  Seed: SHLVEALYLV (INS_HUMAN)
STLVEALYLI

SEQ ID NO: 35585 - protein, 9 aa, Artificial Sequence
  Description of Artificial Sequence: Synthetic peptide
  Seed: AEDLQVGQV (INS_HUMAN)
AFDLQVGQM

SEQ ID NO: 35586 - protein, 9 aa, Artificial Sequence
  Description of Artificial Sequence: Synthetic peptide
  Seed: AAAFVNQHL (INS_HUMAN)
AVAFVNQHF

SEQ ID NO: 35587 - protein, 9 aa, Artificial Sequence
  Description of Artificial Sequence: Synthetic peptide
  Seed: ALWMRLLPL (INS_HUMAN)
AVWMRLLPA

SEQ ID NO: 35588 - protein, 9 aa, Artificial Sequence
  Description of Artificial Sequence: Synthetic peptide
  Seed: HLVEALYLV (INS_HUMAN)
HLVEALYLC

SEQ ID NO: 35589 - protein, 9 aa, Artificial Sequence
  Description of Artificial Sequence: Synthetic peptide
  Seed: AGSLQPLAL (INS_HUMAN)
APSLQPLAF

SEQ ID NO: 35590 - protein, 9 aa, Artificial Sequence
  Description of Artificial Sequence: Synthetic peptide
  Seed: GPDPAAAFV (INS_HUMAN)
GNDPAAAFL

SEQ ID NO: 35591 - protein, 9 aa, Artificial Sequence
  Description of Artificial Sequence: Synthetic peptide
  Seed: YLVCGERGF (INS_HUMAN)
YLVCGERGY

SEQ ID NO: 35592 - protein, 10 aa, Artificial Sequence
  Description of Artificial Sequence: Synthetic peptide
  Seed: MALWMRLLPL (INS_HUMAN)
MRLWMRLLPY

SEQ ID NO: 35593 - protein, 10 aa, Artificial Sequence
  Description of Artificial Sequence: Synthetic peptide
  Seed: LLPLLALLAL (INS_HUMAN)
LPPLLALLAY

SEQ ID NO: 35594 - protein, 11 aa, Artificial Sequence
  Description of Artificial Sequence: Synthetic peptide
  Seed: ALWGPDPAAAF (INS_HUMAN)
ASWGPDPAAAW

SEQ ID NO: 35595 - protein, 11 aa, Artificial Sequence
  Description of Artificial Sequence: Synthetic peptide
  Seed: VELGGGPGAGS (INS_HUMAN)
VELGGGPGAGC

SEQ ID NO: 35596 - protein, 10 aa, Artificial Sequence
  Description of Artificial Sequence: Synthetic peptide
  Seed: WGPDPAAAFV (INS_HUMAN)
WGPDPAAAFL

SEQ ID NO: 35597 - protein, 11 aa, Artificial Sequence
  Description of Artificial Sequence: Synthetic peptide
  Seed: HLVEALYLVCG (INS_HUMAN)
HLVEALYLVCL

SEQ ID NO: 35598 - protein, 10 aa, Artificial Sequence
  Description of Artificial Sequence: Synthetic peptide
  Seed: MALWMRLLPL (INS_HUMAN)
MELWMRLLPY

SEQ ID NO: 35599 - protein, 9 aa, Artificial Sequence
  Description of Artificial Sequence: Synthetic peptide
  Seed: GPDPAAAFV (INS_HUMAN)
GADPAAAFV

SEQ ID NO: 35600 - protein, 9 aa, Artificial Sequence
  Description of Artificial Sequence: Synthetic peptide
  Seed: ALYLVCGER (INS_HUMAN)
AAYLVCGEK

SEQ ID NO: 35601 - protein, 9 aa, Artificial Sequence
  Description of Artificial Sequence: Synthetic peptide
  Seed: GFFYTPKTR (INS_HUMAN)
GVFYTPKTR

SEQ ID NO: 35602 - protein, 9 aa, Artificial Sequence
  Description of Artificial Sequence: Synthetic peptide
  Seed: ALWMRLLPL (INS_HUMAN)
APWMRLLPV

SEQ ID NO: 35603 - protein, 9 aa, Artificial Sequence
  Description of Artificial Sequence: Synthetic peptide
  Seed: RLLPLLALL (INS_HUMAN)
RMLPLLALY

SEQ ID NO: 35604 - protein, 9 aa, Artificial Sequence
  Description of Artificial Sequence: Synthetic peptide
  Seed: GSHLVEALY (INS_HUMAN)
GMHLVEALF

SEQ ID NO: 35605 - protein, 10 aa, Artificial Sequence
  Description of Artificial Sequence: Synthetic peptide
  Seed: HLVEALYLVC (INS_HUMAN)
HLVEALYLVP

SEQ ID NO: 35606 - protein, 9 aa, Artificial Sequence
  Description of Artificial Sequence: Synthetic peptide
  Seed: TSICSLYQL (INS_HUMAN)
TTICSLYQA

SEQ ID NO: 35607 - protein, 10 aa, Artificial Sequence
  Description of Artificial Sequence: Synthetic peptide
  Seed: WGPDPAAAFV (INS_HUMAN)
WWPDPAAAFL

SEQ ID NO: 35608 - protein, 10 aa, Artificial Sequence
  Description of Artificial Sequence: Synthetic peptide
  Seed: MALWMRLLPL (INS_HUMAN)
MNLWMRLLPY

SEQ ID NO: 35609 - protein, 10 aa, Artificial Sequence
  Description of Artificial Sequence: Synthetic peptide
  Seed: MALWMRLLPL (INS_HUMAN)
MFLWMRLLPF

SEQ ID NO: 35610 - protein, 10 aa, Artificial Sequence
  Description of Artificial Sequence: Synthetic peptide
  Seed: VELGGGPGAG (INS_HUMAN)
VELGGGPGAL

SEQ ID NO: 35611 - protein, 9 aa, Artificial Sequence
  Description of Artificial Sequence: Synthetic peptide
  Seed: HLVEALYLV (INS_HUMAN)
HAVEALYLA

SEQ ID NO: 35612 - protein, 8 aa, Artificial Sequence
  Description of Artificial Sequence: Synthetic peptide
  Seed: RGFFYTPK (INS_HUMAN)
RAFFYTPR

SEQ ID NO: 35613 - protein, 9 aa, Artificial Sequence
  Description of Artificial Sequence: Synthetic peptide
  Seed: GPDPAAAFV (INS_HUMAN)
GLDPAAAFL

SEQ ID NO: 35614 - protein, 11 aa, Artificial Sequence
  Description of Artificial Sequence: Synthetic peptide
  Seed: SHLVEALYLVC (INS_HUMAN)
SMLVEALYLVR

SEQ ID NO: 35615 - protein, 11 aa, Artificial Sequence
  Description of Artificial Sequence: Synthetic peptide
  Seed: SHLVEALYLVC (INS_HUMAN)
SLLVEALYLVF

SEQ ID NO: 35616 - protein, 9 aa, Artificial Sequence
  Description of Artificial Sequence: Synthetic peptide
  Seed: YTPKTRREA (INS_HUMAN)
YSPKTRREL

SEQ ID NO: 35617 - protein, 11 aa, Artificial Sequence
  Description of Artificial Sequence: Synthetic peptide
  Seed: ALWGPDPAAAF (INS_HUMAN)
AAWGPDPAAAM

SEQ ID NO: 35618 - protein, 8 aa, Artificial Sequence
  Description of Artificial Sequence: Synthetic peptide
  Seed: LWMRLLPL (INS_HUMAN)
LYMRLLPF

SEQ ID NO: 35619 - protein, 9 aa, Artificial Sequence
  Description of Artificial Sequence: Synthetic peptide
  Seed: ALYLVCGER (INS_HUMAN)
AYYLVCGER

SEQ ID NO: 35620 - protein, 10 aa, Artificial Sequence
  Description of Artificial Sequence: Synthetic peptide
  Seed: MALWMRLLPL (INS_HUMAN)
MWLWMRLLPA

SEQ ID NO: 35621 - protein, 10 aa, Artificial Sequence
  Description of Artificial Sequence: Synthetic peptide
  Seed: WGPDPAAAFV (INS_HUMAN)
WSPDPAAAFL

SEQ ID NO: 35622 - protein, 9 aa, Artificial Sequence
  Description of Artificial Sequence: Synthetic peptide
  Seed: WMRLLPLLA (INS_HUMAN)
WLRLLPLLV

SEQ ID NO: 35623 - protein, 10 aa, Artificial Sequence
  Description of Artificial Sequence: Synthetic peptide
  Seed: WMRLLPLLAL (INS_HUMAN)
WMRLLPLLAV

SEQ ID NO: 35624 - protein, 10 aa, Artificial Sequence
  Description of Artificial Sequence: Synthetic peptide
  Seed: WMRLLPLLAL (INS_HUMAN)
WIRLLPLLAK

SEQ ID NO: 35625 - protein, 9 aa, Artificial Sequence
  Description of Artificial Sequence: Synthetic peptide
  Seed: SHLVEALYL (INS_HUMAN)
SHLVEALYI

SEQ ID NO: 35626 - protein, 11 aa, Artificial Sequence
  Description of Artificial Sequence: Synthetic peptide
  Seed: GSHLVEALYLV (INS_HUMAN)
GRHLVEALYLL

SEQ ID NO: 35627 - protein, 10 aa, Artificial Sequence
  Description of Artificial Sequence: Synthetic peptide
  Seed: MALWMRLLPL (INS_HUMAN)
MALWMRLLPV

SEQ ID NO: 35628 - protein, 9 aa, Artificial Sequence
  Description of Artificial Sequence: Synthetic peptide
  Seed: VELGGGPGA (INS_HUMAN)
VELGGGPGL

SEQ ID NO: 35629 - protein, 9 aa, Artificial Sequence
  Description of Artificial Sequence: Synthetic peptide
  Seed: RLLPLLALL (INS_HUMAN)
RQLPLLALL

SEQ ID NO: 35630 - protein, 8 aa, Artificial Sequence
  Description of Artificial Sequence: Synthetic peptide
  Seed: LWMRLLPL (INS_HUMAN)
LLMRLLPM

SEQ ID NO: 35631 - protein, 11 aa, Artificial Sequence
  Description of Artificial Sequence: Synthetic peptide
  Seed: MALWMRLLPLL (INS_HUMAN)
MSLWMRLLPLW

SEQ ID NO: 35632 - protein, 11 aa, Artificial Sequence
  Description of Artificial Sequence: Synthetic peptide
  Seed: RLLPLLALLAL (INS_HUMAN)
RMLPLLALLAV

SEQ ID NO: 35633 - protein, 9 aa, Artificial Sequence
  Description of Artificial Sequence: Synthetic peptide
  Seed: GPDPAAAFV (INS_HUMAN)
GMDPAAAFL

SEQ ID NO: 35634 - protein, 8 aa, Artificial Sequence
  Description of Artificial Sequence: Synthetic peptide
  Seed: RLLPLLAL (INS_HUMAN)
RMLPLLAV

SEQ ID NO: 35635 - protein, 9 aa, Artificial Sequence
  Description of Artificial Sequence: Synthetic peptide
  Seed: MRLLPLLAL (INS_HUMAN)
MKLLPLLAF

SEQ ID NO: 35636 - protein, 11 aa, Artificial Sequence
  Description of Artificial Sequence: Synthetic peptide
  Seed: VELGGGPGAGS (INS_HUMAN)
VELGGGPGAGL

SEQ ID NO: 35637 - protein, 9 aa, Artificial Sequence
  Description of Artificial Sequence: Synthetic peptide
  Seed: LPLLALLAL (INS_HUMAN)
LALLALLAY

SEQ ID NO: 35638 - protein, 10 aa, Artificial Sequence
  Description of Artificial Sequence: Synthetic peptide
  Seed: WGPDPAAAFV (INS_HUMAN)
WDPDPAAAFL

SEQ ID NO: 35639 - protein, 9 aa, Artificial Sequence
  Description of Artificial Sequence: Synthetic peptide
  Seed: GPDPAAAFV (INS_HUMAN)
GWDPAAAFF

SEQ ID NO: 35640 - protein, 10 aa, Artificial Sequence
  Description of Artificial Sequence: Synthetic peptide
  Seed: LGGGPGAGSL (INS_HUMAN)
LAGGPGAGSF

SEQ ID NO: 35641 - protein, 10 aa, Artificial Sequence
  Description of Artificial Sequence: Synthetic peptide
  Seed: MALWMRLLPL (INS_HUMAN)
MNLWMRLLPA

SEQ ID NO: 35642 - protein, 10 aa, Artificial Sequence
  Description of Artificial Sequence: Synthetic peptide
  Seed: SHLVEALYLV (INS_HUMAN)
STLVEALYLL

SEQ ID NO: 35643 - protein, 9 aa, Artificial Sequence
  Description of Artificial Sequence: Synthetic peptide
  Seed: RLLPLLALL (INS_HUMAN)
RTLPLLALR

SEQ ID NO: 35644 - protein, 9 aa, Artificial Sequence
  Description of Artificial Sequence: Synthetic peptide
  Seed: LALEGSLQK (INS_HUMAN)
LMLEGSLQK

SEQ ID NO: 35645 - protein, 9 aa, Artificial Sequence
  Description of Artificial Sequence: Synthetic peptide
  Seed: MRLLPLLAL (INS_HUMAN)
MMLLPLLAI

SEQ ID NO: 35646 - protein, 11 aa, Artificial Sequence
  Description of Artificial Sequence: Synthetic peptide
  Seed: ALWGPDPAAAF (INS_HUMAN)
ARWGPDPAAAF

SEQ ID NO: 35647 - protein, 11 aa, Artificial Sequence
  Description of Artificial Sequence: Synthetic peptide
  Seed: HLCGSHLVEAL (INS_HUMAN)
HQCGSHLVEAY

SEQ ID NO: 35648 - protein, 10 aa, Artificial Sequence
  Description of Artificial Sequence: Synthetic peptide
  Seed: ALWGPDPAAA (INS_HUMAN)
AMWGPDPAAI

SEQ ID NO: 35649 - protein, 10 aa, Artificial Sequence
  Description of Artificial Sequence: Synthetic peptide
  Seed: LALWGPDPAA (INS_HUMAN)
LLLWGPDPAV

SEQ ID NO: 35650 - protein, 9 aa, Artificial Sequence
  Description of Artificial Sequence: Synthetic peptide
  Seed: REAEDLQVG (INS_HUMAN)
REAEDLQVV

SEQ ID NO: 35651 - protein, 9 aa, Artificial Sequence
  Description of Artificial Sequence: Synthetic peptide
  Seed: WGPDPAAAF (INS_HUMAN)
WMPDPAAAF

SEQ ID NO: 35652 - protein, 10 aa, Artificial Sequence
  Description of Artificial Sequence: Synthetic peptide
  Seed: SHLVEALYLV (INS_HUMAN)
SMLVEALYLM

SEQ ID NO: 35653 - protein, 10 aa, Artificial Sequence
  Description of Artificial Sequence: Synthetic peptide
  Seed: LWMRLLPLLA (INS_HUMAN)
LIMRLLPLLV

SEQ ID NO: 35654 - protein, 9 aa, Artificial Sequence
  Description of Artificial Sequence: Synthetic peptide
  Seed: LALWGPDPA (INS_HUMAN)
LLLWGPDPL

SEQ ID NO: 35655 - protein, 11 aa, Artificial Sequence
  Description of Artificial Sequence: Synthetic peptide
  Seed: SHLVEALYLVC (INS_HUMAN)
SMLVEALYLVP

SEQ ID NO: 35656 - protein, 10 aa, Artificial Sequence
  Description of Artificial Sequence: Synthetic peptide
  Seed: SHLVEALYLV (INS_HUMAN)
SNLVEALYLA

SEQ ID NO: 35657 - protein, 10 aa, Artificial Sequence
  Description of Artificial Sequence: Synthetic peptide
  Seed: WMRLLPLLAL (INS_HUMAN)
WARLLPLLAM

SEQ ID NO: 35658 - protein, 10 aa, Artificial Sequence
  Description of Artificial Sequence: Synthetic peptide
  Seed: LLPLLALLAL (INS_HUMAN)
LMPLLALLAY

SEQ ID NO: 35659 - protein, 10 aa, Artificial Sequence
  Description of Artificial Sequence: Synthetic peptide
  Seed: MRLLPLLALL (INS_HUMAN)
MGLLPLLALM

SEQ ID NO: 35660 - protein, 10 aa, Artificial Sequence
  Description of Artificial Sequence: Synthetic peptide
  Seed: LLPLLALLAL (INS_HUMAN)
LGPLLALLAY

SEQ ID NO: 35661 - protein, 9 aa, Artificial Sequence
  Description of Artificial Sequence: Synthetic peptide
  Seed: YTPKTRREA (INS_HUMAN)
YTPKTRREF

SEQ ID NO: 35662 - protein, 8 aa, Artificial Sequence
  Description of Artificial Sequence: Synthetic peptide
  Seed: RGFFYTPK (INS_HUMAN)
RMFFYTPK

SEQ ID NO: 35663 - protein, 9 aa, Artificial Sequence
  Description of Artificial Sequence: Synthetic peptide
  Seed: AEDLQVGQV (INS_HUMAN)
AMDLQVGQM

SEQ ID NO: 35664 - protein, 9 aa, Artificial Sequence
  Description of Artificial Sequence: Synthetic peptide
  Seed: RLLPLLALL (INS_HUMAN)
RELPLLALY

SEQ ID NO: 35665 - protein, 9 aa, Artificial Sequence
  Description of Artificial Sequence: Synthetic peptide
  Seed: NQHLCGSHL (INS_HUMAN)
NQHLCGSHY

SEQ ID NO: 35666 - protein, 11 aa, Artificial Sequence
  Description of Artificial Sequence: Synthetic peptide
  Seed: ALYLVCGERGF (INS_HUMAN)
AQYLVCGERGY

SEQ ID NO: 35667 - protein, 9 aa, Artificial Sequence
  Description of Artificial Sequence: Synthetic peptide
  Seed: AAFVNQHLC (INS_HUMAN)
ATFVNQHLM

SEQ ID NO: 35668 - protein, 9 aa, Artificial Sequence
  Description of Artificial Sequence: Synthetic peptide
  Seed: TSICSLYQL (INS_HUMAN)
TLICSLYQC

SEQ ID NO: 35669 - protein, 10 aa, Artificial Sequence
  Description of Artificial Sequence: Synthetic peptide
  Seed: MRLLPLLALL (INS_HUMAN)
MNLLPLLALV

SEQ ID NO: 35670 - protein, 10 aa, Artificial Sequence
  Description of Artificial Sequence: Synthetic peptide
  Seed: SHLVEALYLV (INS_HUMAN)
SELVEALYLL

SEQ ID NO: 35671 - protein, 9 aa, Artificial Sequence
  Description of Artificial Sequence: Synthetic peptide
  Seed: RLLPLLALL (INS_HUMAN)
RVLPLLALW

SEQ ID NO: 35672 - protein, 11 aa, Artificial Sequence
  Description of Artificial Sequence: Synthetic peptide
  Seed: RLLPLLALLAL (INS_HUMAN)
RPLPLLALLAL

SEQ ID NO: 35673 - protein, 9 aa, Artificial Sequence
  Description of Artificial Sequence: Synthetic peptide
  Seed: TSICSLYQL (INS_HUMAN)
TSICSLYQY

SEQ ID NO: 35674 - protein, 8 aa, Artificial Sequence
  Description of Artificial Sequence: Synthetic peptide
  Seed: LVEALYLV (INS_HUMAN)
LAEALYLV

SEQ ID NO: 35675 - protein, 10 aa, Artificial Sequence
  Description of Artificial Sequence: Synthetic peptide
  Seed: LLPLLALLAL (INS_HUMAN)
LHPLLALLAL

SEQ ID NO: 35676 - protein, 9 aa, Artificial Sequence
  Description of Artificial Sequence: Synthetic peptide
  Seed: NQHLCGSHL (INS_HUMAN)
NAHLCGSHF

SEQ ID NO: 35677 - protein, 9 aa, Artificial Sequence
  Description of Artificial Sequence: Synthetic peptide
  Seed: FFYTPKTRR (INS_HUMAN)
FAYTPKTRR

SEQ ID NO: 35678 - protein, 11 aa, Artificial Sequence
  Description of Artificial Sequence: Synthetic peptide
  Seed: MALWMRLLPLL (INS_HUMAN)
MMLWMRLLPLA

SEQ ID NO: 35679 - protein, 10 aa, Artificial Sequence
  Description of Artificial Sequence: Synthetic peptide
  Seed: MALWMRLLPL (INS_HUMAN)
MLLWMRLLPM

SEQ ID NO: 35680 - protein, 10 aa, Artificial Sequence
  Description of Artificial Sequence: Synthetic peptide
  Seed: HLVEALYLVC (INS_HUMAN)
HMVEALYLVK

SEQ ID NO: 35681 - protein, 9 aa, Artificial Sequence
  Description of Artificial Sequence: Synthetic peptide
  Seed: RLLPLLALL (INS_HUMAN)
RTLPLLALA

SEQ ID NO: 35682 - protein, 9 aa, Artificial Sequence
  Description of Artificial Sequence: Synthetic peptide
  Seed: RLLPLLALL (INS_HUMAN)
RMLPLLALK

SEQ ID NO: 35683 - protein, 9 aa, Artificial Sequence
  Description of Artificial Sequence: Synthetic peptide
  Seed: NQHLCGSHL (INS_HUMAN)
NIHLCGSHY

SEQ ID NO: 35684 - protein, 9 aa, Artificial Sequence
  Description of Artificial Sequence: Synthetic peptide
  Seed: LPLLALLAL (INS_HUMAN)
LSLLALLAF

SEQ ID NO: 35685 - protein, 9 aa, Artificial Sequence
  Description of Artificial Sequence: Synthetic peptide
  Seed: GERGFFYTP (INS_HUMAN)
GERGFFYTC

SEQ ID NO: 35686 - protein, 9 aa, Artificial Sequence
  Description of Artificial Sequence: Synthetic peptide
  Seed: AAAFVNQHL (INS_HUMAN)
ATAFVNQHL

SEQ ID NO: 35687 - protein, 9 aa, Artificial Sequence
  Description of Artificial Sequence: Synthetic peptide
  Seed: AGSLQPLAL (INS_HUMAN)
AMSLQPLAL

SEQ ID NO: 35688 - protein, 9 aa, Artificial Sequence
  Description of Artificial Sequence: Synthetic peptide
  Seed: AAAFVNQHL (INS_HUMAN)
AQAFVNQHM

SEQ ID NO: 35689 - protein, 11 aa, Artificial Sequence
  Description of Artificial Sequence: Synthetic peptide
  Seed: MALWMRLLPLL (INS_HUMAN)
MELWMRLLPLF

SEQ ID NO: 35690 - protein, 9 aa, Artificial Sequence
  Description of Artificial Sequence: Synthetic peptide
  Seed: RLLPLLALL (INS_HUMAN)
RYLPLLALM

SEQ ID NO: 35691 - protein, 11 aa, Artificial Sequence
  Description of Artificial Sequence: Synthetic peptide
  Seed: GSHLVEALYLV (INS_HUMAN)
GNHLVEALYLI

SEQ ID NO: 35692 - protein, 9 aa, Artificial Sequence
  Description of Artificial Sequence: Synthetic peptide
  Seed: LALWGPDPA (INS_HUMAN)
LQLWGPDPL

SEQ ID NO: 35693 - protein, 9 aa, Artificial Sequence
  Description of Artificial Sequence: Synthetic peptide
  Seed: RLLPLLALL (INS_HUMAN)
RTLPLLALW

SEQ ID NO: 35694 - protein, 9 aa, Artificial Sequence
  Description of Artificial Sequence: Synthetic peptide
  Seed: WGPDPAAAF (INS_HUMAN)
WLPDPAAAM

SEQ ID NO: 35695 - protein, 10 aa, Artificial Sequence
  Description of Artificial Sequence: Synthetic peptide
  Seed: WMRLLPLLAL (INS_HUMAN)
WARLLPLLAI

SEQ ID NO: 35696 - protein, 10 aa, Artificial Sequence
  Description of Artificial Sequence: Synthetic peptide
  Seed: VNQHLCGSHL (INS_HUMAN)
VMQHLCGSHY

SEQ ID NO: 35697 - protein, 10 aa, Artificial Sequence
  Description of Artificial Sequence: Synthetic peptide
  Seed: LALWGPDPAA (INS_HUMAN)
LMLWGPDPAL

SEQ ID NO: 35698 - protein, 10 aa, Artificial Sequence
  Description of Artificial Sequence: Synthetic peptide
  Seed: GIVEQCCTSI (INS_HUMAN)
GLVEQCCTSV

SEQ ID NO: 35699 - protein, 10 aa, Artificial Sequence
  Description of Artificial Sequence: Synthetic peptide
  Seed: MALWMRLLPL (INS_HUMAN)
MILWMRLLPI

SEQ ID NO: 35700 - protein, 10 aa, Artificial Sequence
  Description of Artificial Sequence: Synthetic peptide
  Seed: RLLPLLALLA (INS_HUMAN)
RILPLLALLV

SEQ ID NO: 35701 - protein, 10 aa, Artificial Sequence
  Description of Artificial Sequence: Synthetic peptide
  Seed: LWMRLLPLLA (INS_HUMAN)
LMMRLLPLLV

SEQ ID NO: 35702 - protein, 11 aa, Artificial Sequence
  Description of Artificial Sequence: Synthetic peptide
  Seed: MALWMRLLPLL (INS_HUMAN)
MILWMRLLPLF

SEQ ID NO: 35703 - protein, 9 aa, Artificial Sequence
  Description of Artificial Sequence: Synthetic peptide
  Seed: GSHLVEALY (INS_HUMAN)
GAHLVEALY

SEQ ID NO: 35704 - protein, 9 aa, Artificial Sequence
  Description of Artificial Sequence: Synthetic peptide
  Seed: YTPKTRREA (INS_HUMAN)
YIPKTRREI

SEQ ID NO: 35705 - protein, 11 aa, Artificial Sequence
  Description of Artificial Sequence: Synthetic peptide
  Seed: WMRLLPLLALL (INS_HUMAN)
WARLLPLLALL

SEQ ID NO: 35706 - protein, 10 aa, Artificial Sequence
  Description of Artificial Sequence: Synthetic peptide
  Seed: VNQHLCGSHL (INS_HUMAN)
VSQHLCGSHF

SEQ ID NO: 35707 - protein, 10 aa, Artificial Sequence
  Description of Artificial Sequence: Synthetic peptide
  Seed: MALWMRLLPL (INS_HUMAN)
MGLWMRLLPW

SEQ ID NO: 35708 - protein, 10 aa, Artificial Sequence
  Description of Artificial Sequence: Synthetic peptide
  Seed: LWGPDPAAAF (INS_HUMAN)
LYGPDPAAAL

SEQ ID NO: 35709 - protein, 10 aa, Artificial Sequence
  Description of Artificial Sequence: Synthetic peptide
  Seed: ALWGPDPAAA (INS_HUMAN)
AMWGPDPAAV

SEQ ID NO: 35710 - protein, 10 aa, Artificial Sequence
  Description of Artificial Sequence: Synthetic peptide
  Seed: WMRLLPLLAL (INS_HUMAN)
WGRLLPLLAK

SEQ ID NO: 35711 - protein, 11 aa, Artificial Sequence
  Description of Artificial Sequence: Synthetic peptide
  Seed: AEDLQVGQVEL (INS_HUMAN)
AEDLQVGQVEM

SEQ ID NO: 35712 - protein, 11 aa, Artificial Sequence
  Description of Artificial Sequence: Synthetic peptide
  Seed: AEDLQVGQVEL (INS_HUMAN)
AEDLQVGQVEC

SEQ ID NO: 35713 - protein, 9 aa, Artificial Sequence
  Description of Artificial Sequence: Synthetic peptide
  Seed: MRLLPLLAL (INS_HUMAN)
MNLLPLLAM

SEQ ID NO: 35714 - protein, 10 aa, Artificial Sequence
  Description of Artificial Sequence: Synthetic peptide
  Seed: SHLVEALYLV (INS_HUMAN)
SMLVEALYLA

SEQ ID NO: 35715 - protein, 9 aa, Artificial Sequence
  Description of Artificial Sequence: Synthetic peptide
  Seed: WGPDPAAAF (INS_HUMAN)
WYPDPAAAF

SEQ ID NO: 35716 - protein, 8 aa, Artificial Sequence
  Description of Artificial Sequence: Synthetic peptide
  Seed: GPDPAAAF (INS_HUMAN)
GGDPAAAL

SEQ ID NO: 35717 - protein, 11 aa, Artificial Sequence
  Description of Artificial Sequence: Synthetic peptide
  Seed: LWMRLLPLLAL (INS_HUMAN)
LRMRLLPLLAI

SEQ ID NO: 35718 - protein, 9 aa, Artificial Sequence
  Description of Artificial Sequence: Synthetic peptide
  Seed: AEDLQVGQV (INS_HUMAN)
AGDLQVGQM

SEQ ID NO: 35719 - protein, 10 aa, Artificial Sequence
  Description of Artificial Sequence: Synthetic peptide
  Seed: GFFYTPKTRR (INS_HUMAN)
GMFYTPKTRR

SEQ ID NO: 35720 - protein, 10 aa, Artificial Sequence
  Description of Artificial Sequence: Synthetic peptide
  Seed: MRLLPLLALL (INS_HUMAN)
MALLPLLALM

SEQ ID NO: 35721 - protein, 9 aa, Artificial Sequence
  Description of Artificial Sequence: Synthetic peptide
  Seed: MRLLPLLAL (INS_HUMAN)
MQLLPLLAW

SEQ ID NO: 35722 - protein, 11 aa, Artificial Sequence
  Description of Artificial Sequence: Synthetic peptide
  Seed: RLLPLLALLAL (INS_HUMAN)
RILPLLALLAV

SEQ ID NO: 35723 - protein, 10 aa, Artificial Sequence
  Description of Artificial Sequence: Synthetic peptide
  Seed: VNQHLCGSHL (INS_HUMAN)
VQQHLCGSHY

SEQ ID NO: 35724 - protein, 11 aa, Artificial Sequence
  Description of Artificial Sequence: Synthetic peptide
  Seed: GQVELGGGPGA (INS_HUMAN)
GEVELGGGPGL

SEQ ID NO: 35725 - protein, 10 aa, Artificial Sequence
  Description of Artificial Sequence: Synthetic peptide
  Seed: MALWMRLLPL (INS_HUMAN)
MKLWMRLLPY

SEQ ID NO: 35726 - protein, 9 aa, Artificial Sequence
  Description of Artificial Sequence: Synthetic peptide
  Seed: GERGFFYTP (INS_HUMAN)
GERGFFYTI

SEQ ID NO: 35727 - protein, 10 aa, Artificial Sequence
  Description of Artificial Sequence: Synthetic peptide
  Seed: MALWMRLLPL (INS_HUMAN)
MVLWMRLLPA

SEQ ID NO: 35728 - protein, 10 aa, Artificial Sequence
  Description of Artificial Sequence: Synthetic peptide
  Seed: MRLLPLLALL (INS_HUMAN)
MTLLPLLALI

SEQ ID NO: 35729 - protein, 9 aa, Artificial Sequence
  Description of Artificial Sequence: Synthetic peptide
  Seed: RLLPLLALL (INS_HUMAN)
RLLPLLALK

SEQ ID NO: 35730 - protein, 9 aa, Artificial Sequence
  Description of Artificial Sequence: Synthetic peptide
  Seed: LALEGSLQK (INS_HUMAN)
LALEGSLQV

SEQ ID NO: 35731 - protein, 9 aa, Artificial Sequence
  Description of Artificial Sequence: Synthetic peptide
  Seed: LALWGPDPA (INS_HUMAN)
LPLWGPDPA

SEQ ID NO: 35732 - protein, 10 aa, Artificial Sequence
  Description of Artificial Sequence: Synthetic peptide
  Seed: REAEDLQVGQ (INS_HUMAN)
REAEDLQVGM

SEQ ID NO: 35733 - protein, 10 aa, Artificial Sequence
  Description of Artificial Sequence: Synthetic peptide
  Seed: MALWMRLLPL (INS_HUMAN)
MQLWMRLLPY

SEQ ID NO: 35734 - protein, 9 aa, Artificial Sequence
  Description of Artificial Sequence: Synthetic peptide
  Seed: LWMRLLPLL (INS_HUMAN)
LYMRLLPLL

SEQ ID NO: 35735 - protein, 9 aa, Artificial Sequence
  Description of Artificial Sequence: Synthetic peptide
  Seed: RLLPLLALL (INS_HUMAN)
RMLPLLALR

SEQ ID NO: 35736 - protein, 10 aa, Artificial Sequence
  Description of Artificial Sequence: Synthetic peptide
  Seed: MRLLPLLALL (INS_HUMAN)
MQLLPLLALM

SEQ ID NO: 35737 - protein, 9 aa, Artificial Sequence
  Description of Artificial Sequence: Synthetic peptide
  Seed: FVNQHLCGS (INS_HUMAN)
FQNQHLCGM

SEQ ID NO: 35738 - protein, 10 aa, Artificial Sequence
  Description of Artificial Sequence: Synthetic peptide
  Seed: MALWMRLLPL (INS_HUMAN)
MFLWMRLLPI

SEQ ID NO: 35739 - protein, 9 aa, Artificial Sequence
  Description of Artificial Sequence: Synthetic peptide
  Seed: AAAFVNQHL (INS_HUMAN)
AAAFVNQHF

SEQ ID NO: 35740 - protein, 10 aa, Artificial Sequence
  Description of Artificial Sequence: Synthetic peptide
  Seed: MRLLPLLALL (INS_HUMAN)
MELLPLLALL

SEQ ID NO: 35741 - protein, 9 aa, Artificial Sequence
  Description of Artificial Sequence: Synthetic peptide
  Seed: ALWGPDPAA (INS_HUMAN)
AIWGPDPAV

SEQ ID NO: 35742 - protein, 11 aa, Artificial Sequence
  Description of Artificial Sequence: Synthetic peptide
  Seed: MRLLPLLALLA (INS_HUMAN)
MMLLPLLALLV

SEQ ID NO: 35743 - protein, 9 aa, Artificial Sequence
  Description of Artificial Sequence: Synthetic peptide
  Seed: AAFVNQHLC (INS_HUMAN)
ASFVNQHLV

SEQ ID NO: 35744 - protein, 11 aa, Artificial Sequence
  Description of Artificial Sequence: Synthetic peptide
  Seed: GQVELGGGPGA (INS_HUMAN)
GEVELGGGPGC

SEQ ID NO: 35745 - protein, 11 aa, Artificial Sequence
  Description of Artificial Sequence: Synthetic peptide
  Seed: ALWGPDPAAAF (INS_HUMAN)
AMWGPDPAAAI

SEQ ID NO: 35746 - protein, 9 aa, Artificial Sequence
  Description of Artificial Sequence: Synthetic peptide
  Seed: NQHLCGSHL (INS_HUMAN)
NIHLCGSHF

SEQ ID NO: 35747 - protein, 10 aa, Artificial Sequence
  Description of Artificial Sequence: Synthetic peptide
  Seed: ALWMRLLPLL (INS_HUMAN)
AQWMRLLPLF

SEQ ID NO: 35748 - protein, 10 aa, Artificial Sequence
  Description of Artificial Sequence: Synthetic peptide
  Seed: ICSLYQLENY (INS_HUMAN)
ISSLYQLENY

SEQ ID NO: 35749 - protein, 10 aa, Artificial Sequence
  Description of Artificial Sequence: Synthetic peptide
  Seed: MALWMRLLPL (INS_HUMAN)
MDLWMRLLPM

SEQ ID NO: 35750 - protein, 9 aa, Artificial Sequence
  Description of Artificial Sequence: Synthetic peptide
  Seed: AGSLQPLAL (INS_HUMAN)
ARSLQPLAI

SEQ ID NO: 35751 - protein, 11 aa, Artificial Sequence
  Description of Artificial Sequence: Synthetic peptide
  Seed: SHLVEALYLVC (INS_HUMAN)
SYLVEALYLVV

SEQ ID NO: 35752 - protein, 9 aa, Artificial Sequence
  Description of Artificial Sequence: Synthetic peptide
  Seed: FVNQHLCGS (INS_HUMAN)
FQNQHLCGI

SEQ ID NO: 35753 - protein, 9 aa, Artificial Sequence
  Description of Artificial Sequence: Synthetic peptide
  Seed: YTPKTRREA (INS_HUMAN)
YVPKTRREM

SEQ ID NO: 35754 - protein, 10 aa, Artificial Sequence
  Description of Artificial Sequence: Synthetic peptide
  Seed: LALWGPDPAA (INS_HUMAN)
LKLWGPDPAV

SEQ ID NO: 35755 - protein, 10 aa, Artificial Sequence
  Description of Artificial Sequence: Synthetic peptide
  Seed: WMRLLPLLAL (INS_HUMAN)
WLRLLPLLAM

SEQ ID NO: 35756 - protein, 10 aa, Artificial Sequence
  Description of Artificial Sequence: Synthetic peptide
  Seed: WMRLLPLLAL (INS_HUMAN)
WRRLLPLLAI

SEQ ID NO: 35757 - protein, 9 aa, Artificial Sequence
  Description of Artificial Sequence: Synthetic peptide
  Seed: LALEGSLQK (INS_HUMAN)
LVLEGSLQR

SEQ ID NO: 35758 - protein, 11 aa, Artificial Sequence
  Description of Artificial Sequence: Synthetic peptide
  Seed: YLVCGERGFFY (INS_HUMAN)
YVVCGERGFFY

SEQ ID NO: 35759 - protein, 9 aa, Artificial Sequence
  Description of Artificial Sequence: Synthetic peptide
  Seed: GGGPGAGSL (INS_HUMAN)
GAGPGAGSY

SEQ ID NO: 35760 - protein, 9 aa, Artificial Sequence
  Description of Artificial Sequence: Synthetic peptide
  Seed: ALWMRLLPL (INS_HUMAN)
ARWMRLLPY

SEQ ID NO: 35761 - protein, 9 aa, Artificial Sequence
  Description of Artificial Sequence: Synthetic peptide
  Seed: GSHLVEALY (INS_HUMAN)
GQHLVEALF

SEQ ID NO: 35762 - protein, 10 aa, Artificial Sequence
  Description of Artificial Sequence: Synthetic peptide
  Seed: MALWMRLLPL (INS_HUMAN)
MRLWMRLLPM

SEQ ID NO: 35763 - protein, 9 aa, Artificial Sequence
  Description of Artificial Sequence: Synthetic peptide
  Seed: ALWGPDPAA (INS_HUMAN)
AMWGPDPAR

SEQ ID NO: 35764 - protein, 11 aa, Artificial Sequence
  Description of Artificial Sequence: Synthetic peptide
  Seed: GSHLVEALYLV (INS_HUMAN)
GNHLVEALYLL

SEQ ID NO: 35765 - protein, 9 aa, Artificial Sequence
  Description of Artificial Sequence: Synthetic peptide
  Seed: FVNQHLCGS (INS_HUMAN)
FMNQHLCGT

SEQ ID NO: 35766 - protein, 9 aa, Artificial Sequence
  Description of Artificial Sequence: Synthetic peptide
  Seed: RLLPLLALL (INS_HUMAN)
RWLPLLALF

SEQ ID NO: 35767 - protein, 10 aa, Artificial Sequence
  Description of Artificial Sequence: Synthetic peptide
  Seed: ALWGPDPAAA (INS_HUMAN)
ALWGPDPAAV

SEQ ID NO: 35768 - protein, 8 aa, Artificial Sequence
  Description of Artificial Sequence: Synthetic peptide
  Seed: GSHLVEAL (INS_HUMAN)
GQHLVEAL

SEQ ID NO: 35769 - protein, 10 aa, Artificial Sequence
  Description of Artificial Sequence: Synthetic peptide
  Seed: ALWMRLLPLL (INS_HUMAN)
AYWMRLLPLL

SEQ ID NO: 35770 - protein, 10 aa, Artificial Sequence
  Description of Artificial Sequence: Synthetic peptide
  Seed: CGSHLVEALY (INS_HUMAN)
CRSHLVEALY

SEQ ID NO: 35771 - protein, 10 aa, Artificial Sequence
  Description of Artificial Sequence: Synthetic peptide
  Seed: SHLVEALYLV (INS_HUMAN)
SILVEALYLI

SEQ ID NO: 35772 - protein, 9 aa, Artificial Sequence
  Description of Artificial Sequence: Synthetic peptide
  Seed: QPLALEGSL (INS_HUMAN)
QPLALEGSW

SEQ ID NO: 35773 - protein, 10 aa, Artificial Sequence
  Description of Artificial Sequence: Synthetic peptide
  Seed: MRLLPLLALL (INS_HUMAN)
MDLLPLLALV

SEQ ID NO: 35774 - protein, 10 aa, Artificial Sequence
  Description of Artificial Sequence: Synthetic peptide
  Seed: WMRLLPLLAL (INS_HUMAN)
WERLLPLLAM

SEQ ID NO: 35775 - protein, 11 aa, Artificial Sequence
  Description of Artificial Sequence: Synthetic peptide
  Seed: MALWMRLLPLL (INS_HUMAN)
MCLWMRLLPLF

SEQ ID NO: 35776 - protein, 9 aa, Artificial Sequence
  Description of Artificial Sequence: Synthetic peptide
  Seed: AAAFVNQHL (INS_HUMAN)
ATAFVNQHY

SEQ ID NO: 35777 - protein, 10 aa, Artificial Sequence
  Description of Artificial Sequence: Synthetic peptide
  Seed: MRLLPLLALL (INS_HUMAN)
MLLLPLLALL

SEQ ID NO: 35778 - protein, 9 aa, Artificial Sequence
  Description of Artificial Sequence: Synthetic peptide
  Seed: ALWMRLLPL (INS_HUMAN)
AIWMRLLPA

SEQ ID NO: 35779 - protein, 11 aa, Artificial Sequence
  Description of Artificial Sequence: Synthetic peptide
  Seed: SHLVEALYLVC (INS_HUMAN)
SKLVEALYLVL

SEQ ID NO: 35780 - protein, 10 aa, Artificial Sequence
  Description of Artificial Sequence: Synthetic peptide
  Seed: MRLLPLLALL (INS_HUMAN)
MCLLPLLALM

SEQ ID NO: 35781 - protein, 11 aa, Artificial Sequence
  Description of Artificial Sequence: Synthetic peptide
  Seed: MALWMRLLPLL (INS_HUMAN)
MLLWMRLLPLA

SEQ ID NO: 35782 - protein, 10 aa, Artificial Sequence
  Description of Artificial Sequence: Synthetic peptide
  Seed: SHLVEALYLV (INS_HUMAN)
SFLVEALYLA

SEQ ID NO: 35783 - protein, 9 aa, Artificial Sequence
  Description of Artificial Sequence: Synthetic peptide
  Seed: TSICSLYQL (INS_HUMAN)
TMICSLYQT

SEQ ID NO: 35784 - protein, 11 aa, Artificial Sequence
  Description of Artificial Sequence: Synthetic peptide
  Seed: REAEDLQVGQV (INS_HUMAN)
RMAEDLQVGQL

SEQ ID NO: 35785 - protein, 10 aa, Artificial Sequence
  Description of Artificial Sequence: Synthetic peptide
  Seed: MALWMRLLPL (INS_HUMAN)
MPLWMRLLPI

SEQ ID NO: 35786 - protein, 11 aa, Artificial Sequence
  Description of Artificial Sequence: Synthetic peptide
  Seed: MALWMRLLPLL (INS_HUMAN)
MHLWMRLLPLF

SEQ ID NO: 35787 - protein, 9 aa, Artificial Sequence
  Description of Artificial Sequence: Synthetic peptide
  Seed: MRLLPLLAL (INS_HUMAN)
MQLLPLLAL

SEQ ID NO: 35788 - protein, 9 aa, Artificial Sequence
  Description of Artificial Sequence: Synthetic peptide
  Seed: TSICSLYQL (INS_HUMAN)
TLICSLYQI

SEQ ID NO: 35789 - protein, 10 aa, Artificial Sequence
  Description of Artificial Sequence: Synthetic peptide
  Seed: RGFFYTPKTR (INS_HUMAN)
RIFFYTPKTK

SEQ ID NO: 35790 - protein, 9 aa, Artificial Sequence
  Description of Artificial Sequence: Synthetic peptide
  Seed: TSICSLYQL (INS_HUMAN)
TVICSLYQM

SEQ ID NO: 35791 - protein, 9 aa, Artificial Sequence
  Description of Artificial Sequence: Synthetic peptide
  Seed: MALWMRLLP (INS_HUMAN)
MPLWMRLLL

SEQ ID NO: 35792 - protein, 9 aa, Artificial Sequence
  Description of Artificial Sequence: Synthetic peptide
  Seed: LLPLLALLA (INS_HUMAN)
LMPLLALLV

SEQ ID NO: 35793 - protein, 9 aa, Artificial Sequence
  Description of Artificial Sequence: Synthetic peptide
  Seed: ALYLVCGER (INS_HUMAN)
AIYLVCGEK

SEQ ID NO: 35794 - protein, 10 aa, Artificial Sequence
  Description of Artificial Sequence: Synthetic peptide
  Seed: ALWMRLLPLL (INS_HUMAN)
AEWMRLLPLF

SEQ ID NO: 35795 - protein, 10 aa, Artificial Sequence
  Description of Artificial Sequence: Synthetic peptide
  Seed: SHLVEALYLV (INS_HUMAN)
SDLVEALYLI

SEQ ID NO: 35796 - protein, 9 aa, Artificial Sequence
  Description of Artificial Sequence: Synthetic peptide
  Seed: AGSLQPLAL (INS_HUMAN)
ALSLQPLAM

SEQ ID NO: 35797 - protein, 9 aa, Artificial Sequence
  Description of Artificial Sequence: Synthetic peptide
  Seed: ALWGPDPAA (INS_HUMAN)
AQWGPDPAL

SEQ ID NO: 35798 - protein, 10 aa, Artificial Sequence
  Description of Artificial Sequence: Synthetic peptide
  Seed: WMRLLPLLAL (INS_HUMAN)
WLRLLPLLAY

SEQ ID NO: 35799 - protein, 9 aa, Artificial Sequence
  Description of Artificial Sequence: Synthetic peptide
  Seed: LWMRLLPLL (INS_HUMAN)
LWMRLLPLF

SEQ ID NO: 35800 - protein, 9 aa, Artificial Sequence
  Description of Artificial Sequence: Synthetic peptide
  Seed: TSICSLYQL (INS_HUMAN)
TIICSLYQV

SEQ ID NO: 35801 - protein, 10 aa, Artificial Sequence
  Description of Artificial Sequence: Synthetic peptide
  Seed: MALWMRLLPL (INS_HUMAN)
MLLWMRLLPI

SEQ ID NO: 35802 - protein, 10 aa, Artificial Sequence
  Description of Artificial Sequence: Synthetic peptide
  Seed: LWGPDPAAAF (INS_HUMAN)
LIGPDPAAAF

SEQ ID NO: 35803 - protein, 9 aa, Artificial Sequence
  Description of Artificial Sequence: Synthetic peptide
  Seed: LALEGSLQK (INS_HUMAN)
LTLEGSLQY

SEQ ID NO: 35804 - protein, 10 aa, Artificial Sequence
  Description of Artificial Sequence: Synthetic peptide
  Seed: MRLLPLLALL (INS_HUMAN)
MSLLPLLALL

SEQ ID NO: 35805 - protein, 8 aa, Artificial Sequence
  Description of Artificial Sequence: Synthetic peptide
  Seed: RGFFYTPK (INS_HUMAN)
RWFFYTPR

SEQ ID NO: 35806 - protein, 10 aa, Artificial Sequence
  Description of Artificial Sequence: Synthetic peptide
  Seed: MALWMRLLPL (INS_HUMAN)
MNLWMRLLPF

SEQ ID NO: 35807 - protein, 10 aa, Artificial Sequence
  Description of Artificial Sequence: Synthetic peptide
  Seed: HLCGSHLVEA (INS_HUMAN)
HLCGSHLVEI

SEQ ID NO: 35808 - protein, 10 aa, Artificial Sequence
  Description of Artificial Sequence: Synthetic peptide
  Seed: MALWMRLLPL (INS_HUMAN)
MALWMRLLPI

SEQ ID NO: 35809 - protein, 11 aa, Artificial Sequence
  Description of Artificial Sequence: Synthetic peptide
  Seed: MALWMRLLPLL (INS_HUMAN)
MRLWMRLLPLF

SEQ ID NO: 35810 - protein, 9 aa, Artificial Sequence
  Description of Artificial Sequence: Synthetic peptide
  Seed: NQHLCGSHL (INS_HUMAN)
NHHLCGSHA

SEQ ID NO: 35811 - protein, 9 aa, Artificial Sequence
  Description of Artificial Sequence: Synthetic peptide
  Seed: VCGERGFFY (INS_HUMAN)
VMGERGFFY

SEQ ID NO: 35812 - protein, 11 aa, Artificial Sequence
  Description of Artificial Sequence: Synthetic peptide
  Seed: GSHLVEALYLV (INS_HUMAN)
GWHLVEALYLI

SEQ ID NO: 35813 - protein, 9 aa, Artificial Sequence
  Description of Artificial Sequence: Synthetic peptide
  Seed: AAFVNQHLC (INS_HUMAN)
AAFVNQHLV

SEQ ID NO: 35814 - protein, 9 aa, Artificial Sequence
  Description of Artificial Sequence: Synthetic peptide
  Seed: HLVEALYLV (INS_HUMAN)
HMVEALYLK

SEQ ID NO: 35815 - protein, 9 aa, Artificial Sequence
  Description of Artificial Sequence: Synthetic peptide
  Seed: ALWMRLLPL (INS_HUMAN)
AKWMRLLPY

SEQ ID NO: 35816 - protein, 11 aa, Artificial Sequence
  Description of Artificial Sequence: Synthetic peptide
  Seed: REAEDLQVGQV (INS_HUMAN)
REAEDLQVGQC

SEQ ID NO: 35817 - protein, 11 aa, Artificial Sequence
  Description of Artificial Sequence: Synthetic peptide
  Seed: SHLVEALYLVC (INS_HUMAN)
SMLVEALYLVK

SEQ ID NO: 35818 - protein, 9 aa, Artificial Sequence
  Description of Artificial Sequence: Synthetic peptide
  Seed: AGSLQPLAL (INS_HUMAN)
APSLQPLAL

SEQ ID NO: 35819 - protein, 9 aa, Artificial Sequence
  Description of Artificial Sequence: Synthetic peptide
  Seed: FVNQHLCGS (INS_HUMAN)
FINQHLCGM

SEQ ID NO: 35820 - protein, 9 aa, Artificial Sequence
  Description of Artificial Sequence: Synthetic peptide
  Seed: REAEDLQVG (INS_HUMAN)
REAEDLQVW

SEQ ID NO: 35821 - protein, 9 aa, Artificial Sequence
  Description of Artificial Sequence: Synthetic peptide
  Seed: YTPKTRREA (INS_HUMAN)
YVPKTRREL

SEQ ID NO: 35822 - protein, 10 aa, Artificial Sequence
  Description of Artificial Sequence: Synthetic peptide
  Seed: ALWMRLLPLL (INS_HUMAN)
ALWMRLLPLF

SEQ ID NO: 35823 - protein, 9 aa, Artificial Sequence
  Description of Artificial Sequence: Synthetic peptide
  Seed: RLLPLLALL (INS_HUMAN)
RWLPLLALK

SEQ ID NO: 35824 - protein, 9 aa, Artificial Sequence
  Description of Artificial Sequence: Synthetic peptide
  Seed: RLLPLLALL (INS_HUMAN)
RMLPLLALT

SEQ ID NO: 35825 - protein, 10 aa, Artificial Sequence
  Description of Artificial Sequence: Synthetic peptide
  Seed: SHLVEALYLV (INS_HUMAN)
SRLVEALYLV

SEQ ID NO: 35826 - protein, 10 aa, Artificial Sequence
  Description of Artificial Sequence: Synthetic peptide
  Seed: MRLLPLLALL (INS_HUMAN)
MPLLPLLALV

SEQ ID NO: 35827 - protein, 9 aa, Artificial Sequence
  Description of Artificial Sequence: Synthetic peptide
  Seed: MALWMRLLP (INS_HUMAN)
MPLWMRLLS

SEQ ID NO: 35828 - protein, 10 aa, Artificial Sequence
  Description of Artificial Sequence: Synthetic peptide
  Seed: SHLVEALYLV (INS_HUMAN)
SCLVEALYLA

SEQ ID NO: 35829 - protein, 9 aa, Artificial Sequence
  Description of Artificial Sequence: Synthetic peptide
  Seed: LPLLALLAL (INS_HUMAN)
LPLLALLAW

SEQ ID NO: 35830 - protein, 11 aa, Artificial Sequence
  Description of Artificial Sequence: Synthetic peptide
  Seed: WMRLLPLLALL (INS_HUMAN)
WRRLLPLLALK

SEQ ID NO: 35831 - protein, 9 aa, Artificial Sequence
  Description of Artificial Sequence: Synthetic peptide
  Seed: LWMRLLPLL (INS_HUMAN)
LFMRLLPLW

SEQ ID NO: 35832 - protein, 11 aa, Artificial Sequence
  Description of Artificial Sequence: Synthetic peptide
  Seed: MALWMRLLPLL (INS_HUMAN)
MLLWMRLLPLV

SEQ ID NO: 35833 - protein, 9 aa, Artificial Sequence
  Description of Artificial Sequence: Synthetic peptide
  Seed: ALWMRLLPL (INS_HUMAN)
ASWMRLLPV

SEQ ID NO: 35834 - protein, 11 aa, Artificial Sequence
  Description of Artificial Sequence: Synthetic peptide
  Seed: MALWMRLLPLL (INS_HUMAN)
MNLWMRLLPLF

SEQ ID NO: 35835 - protein, 10 aa, Artificial Sequence
  Description of Artificial Sequence: Synthetic peptide
  Seed: ALWMRLLPLL (INS_HUMAN)
AMWMRLLPLL

SEQ ID NO: 35836 - protein, 11 aa, Artificial Sequence
  Description of Artificial Sequence: Synthetic peptide
  Seed: ALWGPDPAAAF (INS_HUMAN)
AHWGPDPAAAY

SEQ ID NO: 35837 - protein, 11 aa, Artificial Sequence
  Description of Artificial Sequence: Synthetic peptide
  Seed: ALWGPDPAAAF (INS_HUMAN)
AIWGPDPAAAR

SEQ ID NO: 35838 - protein, 11 aa, Artificial Sequence
  Description of Artificial Sequence: Synthetic peptide
  Seed: WMRLLPLLALL (INS_HUMAN)
WARLLPLLALV

SEQ ID NO: 35839 - protein, 9 aa, Artificial Sequence
  Description of Artificial Sequence: Synthetic peptide
  Seed: ALWMRLLPL (INS_HUMAN)
AAWMRLLPF

SEQ ID NO: 35840 - protein, 10 aa, Artificial Sequence
  Description of Artificial Sequence: Synthetic peptide
  Seed: MRLLPLLALL (INS_HUMAN)
MHLLPLLALL

SEQ ID NO: 35841 - protein, 9 aa, Artificial Sequence
  Description of Artificial Sequence: Synthetic peptide
  Seed: RLLPLLALL (INS_HUMAN)
RRLPLLALC

SEQ ID NO: 35842 - protein, 10 aa, Artificial Sequence
  Description of Artificial Sequence: Synthetic peptide
  Seed: RLLPLLALLA (INS_HUMAN)
RMLPLLALLC

SEQ ID NO: 35843 - protein, 9 aa, Artificial Sequence
  Description of Artificial Sequence: Synthetic peptide
  Seed: TSICSLYQL (INS_HUMAN)
TQICSLYQM

SEQ ID NO: 35844 - protein, 11 aa, Artificial Sequence
  Description of Artificial Sequence: Synthetic peptide
  Seed: GSHLVEALYLV (INS_HUMAN)
GDHLVEALYLL

SEQ ID NO: 35845 - protein, 11 aa, Artificial Sequence
  Description of Artificial Sequence: Synthetic peptide
  Seed: WMRLLPLLALL (INS_HUMAN)
WQRLLPLLALL

SEQ ID NO: 35846 - protein, 9 aa, Artificial Sequence
  Description of Artificial Sequence: Synthetic peptide
  Seed: FVNQHLCGS (INS_HUMAN)
FANQHLCGV

SEQ ID NO: 35847 - protein, 10 aa, Artificial Sequence
  Description of Artificial Sequence: Synthetic peptide
  Seed: VNQHLCGSHL (INS_HUMAN)
VWQHLCGSHY

SEQ ID NO: 35848 - protein, 11 aa, Artificial Sequence
  Description of Artificial Sequence: Synthetic peptide
  Seed: MRLLPLLALLA (INS_HUMAN)
MRLLPLLALLL

SEQ ID NO: 35849 - protein, 11 aa, Artificial Sequence
  Description of Artificial Sequence: Synthetic peptide
  Seed: HLCGSHLVEAL (INS_HUMAN)
HMCGSHLVEAY

SEQ ID NO: 35850 - protein, 9 aa, Artificial Sequence
  Description of Artificial Sequence: Synthetic peptide
  Seed: LPLLALLAL (INS_HUMAN)
LMLLALLAF

SEQ ID NO: 35851 - protein, 11 aa, Artificial Sequence
  Description of Artificial Sequence: Synthetic peptide
  Seed: RGFFYTPKTRR (INS_HUMAN)
RDFFYTPKTRR

SEQ ID NO: 35852 - protein, 10 aa, Artificial Sequence
  Description of Artificial Sequence: Synthetic peptide
  Seed: MRLLPLLALL (INS_HUMAN)
MVLLPLLALA

SEQ ID NO: 35853 - protein, 9 aa, Artificial Sequence
  Description of Artificial Sequence: Synthetic peptide
  Seed: MRLLPLLAL (INS_HUMAN)
MNLLPLLAY

SEQ ID NO: 35854 - protein, 9 aa, Artificial Sequence
  Description of Artificial Sequence: Synthetic peptide
  Seed: TSICSLYQL (INS_HUMAN)
TVICSLYQW

SEQ ID NO: 35855 - protein, 9 aa, Artificial Sequence
  Description of Artificial Sequence: Synthetic peptide
  Seed: MRLLPLLAL (INS_HUMAN)
MLLLPLLAM

SEQ ID NO: 35856 - protein, 10 aa, Artificial Sequence
  Description of Artificial Sequence: Synthetic peptide
  Seed: SHLVEALYLV (INS_HUMAN)
SWLVEALYLL

SEQ ID NO: 35857 - protein, 10 aa, Artificial Sequence
  Description of Artificial Sequence: Synthetic peptide
  Seed: SHLVEALYLV (INS_HUMAN)
STLVEALYLM

SEQ ID NO: 35858 - protein, 10 aa, Artificial Sequence
  Description of Artificial Sequence: Synthetic peptide
  Seed: LLPLLALLAL (INS_HUMAN)
LHPLLALLAY

SEQ ID NO: 35859 - protein, 11 aa, Artificial Sequence
  Description of Artificial Sequence: Synthetic peptide
  Seed: ALWGPDPAAAF (INS_HUMAN)
AMWGPDPAAAL

SEQ ID NO: 35860 - protein, 10 aa, Artificial Sequence
  Description of Artificial Sequence: Synthetic peptide
  Seed: HLVEALYLVC (INS_HUMAN)
HLVEALYLVF

SEQ ID NO: 35861 - protein, 10 aa, Artificial Sequence
  Description of Artificial Sequence: Synthetic peptide
  Seed: MRLLPLLALL (INS_HUMAN)
MKLLPLLALL

SEQ ID NO: 35862 - protein, 10 aa, Artificial Sequence
  Description of Artificial Sequence: Synthetic peptide
  Seed: LWGPDPAAAF (INS_HUMAN)
LLGPDPAAAF

SEQ ID NO: 35863 - protein, 11 aa, Artificial Sequence
  Description of Artificial Sequence: Synthetic peptide
  Seed: MRLLPLLALLA (INS_HUMAN)
MKLLPLLALLV

SEQ ID NO: 35864 - protein, 10 aa, Artificial Sequence
  Description of Artificial Sequence: Synthetic peptide
  Seed: MALWMRLLPL (INS_HUMAN)
MLLWMRLLPY

SEQ ID NO: 35865 - protein, 11 aa, Artificial Sequence
  Description of Artificial Sequence: Synthetic peptide
  Seed: SHLVEALYLVC (INS_HUMAN)
SYLVEALYLVI

SEQ ID NO: 35866 - protein, 9 aa, Artificial Sequence
  Description of Artificial Sequence: Synthetic peptide
  Seed: GSHLVEALY (INS_HUMAN)
GFHLVEALY

SEQ ID NO: 35867 - protein, 9 aa, Artificial Sequence
  Description of Artificial Sequence: Synthetic peptide
  Seed: LALWGPDPA (INS_HUMAN)
LILWGPDPI

SEQ ID NO: 35868 - protein, 9 aa, Artificial Sequence
  Description of Artificial Sequence: Synthetic peptide
  Seed: RLLPLLALL (INS_HUMAN)
RELPLLALF

SEQ ID NO: 35869 - protein, 11 aa, Artificial Sequence
  Description of Artificial Sequence: Synthetic peptide
  Seed: WMRLLPLLALL (INS_HUMAN)
WSRLLPLLALV

SEQ ID NO: 35870 - protein, 9 aa, Artificial Sequence
  Description of Artificial Sequence: Synthetic peptide
  Seed: RLLPLLALL (INS_HUMAN)
RNLPLLALR

SEQ ID NO: 35871 - protein, 11 aa, Artificial Sequence
  Description of Artificial Sequence: Synthetic peptide
  Seed: SHLVEALYLVC (INS_HUMAN)
SLLVEALYLVG

SEQ ID NO: 35872 - protein, 9 aa, Artificial Sequence
  Description of Artificial Sequence: Synthetic peptide
  Seed: ALWMRLLPL (INS_HUMAN)
AEWMRLLPF

SEQ ID NO: 35873 - protein, 10 aa, Artificial Sequence
  Description of Artificial Sequence: Synthetic peptide
  Seed: WGPDPAAAFV (INS_HUMAN)
WRPDPAAAFL

SEQ ID NO: 35874 - protein, 9 aa, Artificial Sequence
  Description of Artificial Sequence: Synthetic peptide
  Seed: ALWMRLLPL (INS_HUMAN)
ATWMRLLPA

SEQ ID NO: 35875 - protein, 10 aa, Artificial Sequence
  Description of Artificial Sequence: Synthetic peptide
  Seed: AEDLQVGQVE (INS_HUMAN)
AEDLQVGQVA

SEQ ID NO: 35876 - protein, 9 aa, Artificial Sequence
  Description of Artificial Sequence: Synthetic peptide
  Seed: AEDLQVGQV (INS_HUMAN)
AMDLQVGQL

SEQ ID NO: 35877 - protein, 9 aa, Artificial Sequence
  Description of Artificial Sequence: Synthetic peptide
  Seed: RLLPLLALL (INS_HUMAN)
RILPLLALI

SEQ ID NO: 35878 - protein, 10 aa, Artificial Sequence
  Description of Artificial Sequence: Synthetic peptide
  Seed: MALWMRLLPL (INS_HUMAN)
MMLWMRLLPL

SEQ ID NO: 35879 - protein, 9 aa, Artificial Sequence
  Description of Artificial Sequence: Synthetic peptide
  Seed: FVNQHLCGS (INS_HUMAN)
FANQHLCGL

SEQ ID NO: 35880 - protein, 10 aa, Artificial Sequence
  Description of Artificial Sequence: Synthetic peptide
  Seed: WMRLLPLLAL (INS_HUMAN)
WHRLLPLLAK

SEQ ID NO: 35881 - protein, 10 aa, Artificial Sequence
  Description of Artificial Sequence: Synthetic peptide
  Seed: LVCGERGFFY (INS_HUMAN)
LACGERGFFW

SEQ ID NO: 35882 - protein, 9 aa, Artificial Sequence
  Description of Artificial Sequence: Synthetic peptide
  Seed: ALWMRLLPL (INS_HUMAN)
AVWMRLLPL

SEQ ID NO: 35883 - protein, 9 aa, Artificial Sequence
  Description of Artificial Sequence: Synthetic peptide
  Seed: AEDLQVGQV (INS_HUMAN)
AADLQVGQM

SEQ ID NO: 35884 - protein, 9 aa, Artificial Sequence
  Description of Artificial Sequence: Synthetic peptide
  Seed: AEDLQVGQV (INS_HUMAN)
ASDLQVGQI

SEQ ID NO: 35885 - protein, 11 aa, Artificial Sequence
  Description of Artificial Sequence: Synthetic peptide
  Seed: GSHLVEALYLV (INS_HUMAN)
GAHLVEALYLV

SEQ ID NO: 35886 - protein, 9 aa, Artificial Sequence
  Description of Artificial Sequence: Synthetic peptide
  Seed: AEDLQVGQV (INS_HUMAN)
ASDLQVGQL

SEQ ID NO: 35887 - protein, 9 aa, Artificial Sequence
  Description of Artificial Sequence: Synthetic peptide
  Seed: AAAFVNQHL (INS_HUMAN)
AMAFVNQHI

SEQ ID NO: 35888 - protein, 11 aa, Artificial Sequence
  Description of Artificial Sequence: Synthetic peptide
  Seed: MALWMRLLPLL (INS_HUMAN)
MPLWMRLLPLF

SEQ ID NO: 35889 - protein, 9 aa, Artificial Sequence
  Description of Artificial Sequence: Synthetic peptide
  Seed: FVNQHLCGS (INS_HUMAN)
FQNQHLCGV

SEQ ID NO: 35890 - protein, 9 aa, Artificial Sequence
  Description of Artificial Sequence: Synthetic peptide
  Seed: ALWMRLLPL (INS_HUMAN)
AQWMRLLPV

SEQ ID NO: 35891 - protein, 9 aa, Artificial Sequence
  Description of Artificial Sequence: Synthetic peptide
  Seed: ALYLVCGER (INS_HUMAN)
AVYLVCGEK

SEQ ID NO: 35892 - protein, 9 aa, Artificial Sequence
  Description of Artificial Sequence: Synthetic peptide
  Seed: RLLPLLALL (INS_HUMAN)
RCLPLLALW

SEQ ID NO: 35893 - protein, 9 aa, Artificial Sequence
  Description of Artificial Sequence: Synthetic peptide
  Seed: HLVEALYLV (INS_HUMAN)
HTVEALYLM

SEQ ID NO: 35894 - protein, 11 aa, Artificial Sequence
  Description of Artificial Sequence: Synthetic peptide
  Seed: MALWMRLLPLL (INS_HUMAN)
MLLWMRLLPLL

SEQ ID NO: 35895 - protein, 9 aa, Artificial Sequence
  Description of Artificial Sequence: Synthetic peptide
  Seed: AAAFVNQHL (INS_HUMAN)
ALAFVNQHL

SEQ ID NO: 35896 - protein, 10 aa, Artificial Sequence
  Description of Artificial Sequence: Synthetic peptide
  Seed: HLVEALYLVC (INS_HUMAN)
HMVEALYLVN

SEQ ID NO: 35897 - protein, 9 aa, Artificial Sequence
  Description of Artificial Sequence: Synthetic peptide
  Seed: RLLPLLALL (INS_HUMAN)
RQLPLLALW

SEQ ID NO: 35898 - protein, 11 aa, Artificial Sequence
  Description of Artificial Sequence: Synthetic peptide
  Seed: YLVCGERGFFY (INS_HUMAN)
YTVCGERGFFY

SEQ ID NO: 35899 - protein, 9 aa, Artificial Sequence
  Description of Artificial Sequence: Synthetic peptide
  Seed: YLVCGERGF (INS_HUMAN)
YIVCGERGY

SEQ ID NO: 35900 - protein, 10 aa, Artificial Sequence
  Description of Artificial Sequence: Synthetic peptide
  Seed: HLVEALYLVC (INS_HUMAN)
HLVEALYLVH

SEQ ID NO: 35901 - protein, 9 aa, Artificial Sequence
  Description of Artificial Sequence: Synthetic peptide
  Seed: AGSLQPLAL (INS_HUMAN)
AYSLQPLAL

SEQ ID NO: 35902 - protein, 10 aa, Artificial Sequence
  Description of Artificial Sequence: Synthetic peptide
  Seed: REAEDLQVGQ (INS_HUMAN)
REAEDLQVGA

SEQ ID NO: 35903 - protein, 9 aa, Artificial Sequence
  Description of Artificial Sequence: Synthetic peptide
  Seed: NQHLCGSHL (INS_HUMAN)
NKHLCGSHY

SEQ ID NO: 35904 - protein, 11 aa, Artificial Sequence
  Description of Artificial Sequence: Synthetic peptide
  Seed: MALWMRLLPLL (INS_HUMAN)
MYLWMRLLPLW

SEQ ID NO: 35905 - protein, 10 aa, Artificial Sequence
  Description of Artificial Sequence: Synthetic peptide
  Seed: WMRLLPLLAL (INS_HUMAN)
WQRLLPLLAK

SEQ ID NO: 35906 - protein, 9 aa, Artificial Sequence
  Description of Artificial Sequence: Synthetic peptide
  Seed: HLVEALYLV (INS_HUMAN)
HVVEALYLL

SEQ ID NO: 35907 - protein, 10 aa, Artificial Sequence
  Description of Artificial Sequence: Synthetic peptide
  Seed: MRLLPLLALL (INS_HUMAN)
MPLLPLLALM

SEQ ID NO: 35908 - protein, 11 aa, Artificial Sequence
  Description of Artificial Sequence: Synthetic peptide
  Seed: RLLPLLALLAL (INS_HUMAN)
RMLPLLALLAL

SEQ ID NO: 35909 - protein, 10 aa, Artificial Sequence
  Description of Artificial Sequence: Synthetic peptide
  Seed: SHLVEALYLV (INS_HUMAN)
SPLVEALYLV

SEQ ID NO: 35910 - protein, 10 aa, Artificial Sequence
  Description of Artificial Sequence: Synthetic peptide
  Seed: SHLVEALYLV (INS_HUMAN)
SWLVEALYLM

SEQ ID NO: 35911 - protein, 11 aa, Artificial Sequence
  Description of Artificial Sequence: Synthetic peptide
  Seed: ALWGPDPAAAF (INS_HUMAN)
ALWGPDPAAAM

SEQ ID NO: 35912 - protein, 9 aa, Artificial Sequence
  Description of Artificial Sequence: Synthetic peptide
  Seed: YTPKTRREA (INS_HUMAN)
YLPKTRREL

SEQ ID NO: 35913 - protein, 10 aa, Artificial Sequence
  Description of Artificial Sequence: Synthetic peptide
  Seed: MALWMRLLPL (INS_HUMAN)
MLLWMRLLPF

SEQ ID NO: 35914 - protein, 9 aa, Artificial Sequence
  Description of Artificial Sequence: Synthetic peptide
  Seed: WGPDPAAAF (INS_HUMAN)
WIPDPAAAL

SEQ ID NO: 35915 - protein, 9 aa, Artificial Sequence
  Description of Artificial Sequence: Synthetic peptide
  Seed: ALYLVCGER (INS_HUMAN)
ALYLVCGEK

SEQ ID NO: 35916 - protein, 10 aa, Artificial Sequence
  Description of Artificial Sequence: Synthetic peptide
  Seed: HLVEALYLVC (INS_HUMAN)
HMVEALYLVA

SEQ ID NO: 35917 - protein, 10 aa, Artificial Sequence
  Description of Artificial Sequence: Synthetic peptide
  Seed: MALWMRLLPL (INS_HUMAN)
MSLWMRLLPW

SEQ ID NO: 35918 - protein, 11 aa, Artificial Sequence
  Description of Artificial Sequence: Synthetic peptide
  Seed: ALWGPDPAAAF (INS_HUMAN)
AMWGPDPAAAR

SEQ ID NO: 35919 - protein, 9 aa, Artificial Sequence
  Description of Artificial Sequence: Synthetic peptide
  Seed: ALWMRLLPL (INS_HUMAN)
AVWMRLLPF

SEQ ID NO: 35920 - protein, 10 aa, Artificial Sequence
  Description of Artificial Sequence: Synthetic peptide
  Seed: MALWMRLLPL (INS_HUMAN)
MELWMRLLPF

SEQ ID NO: 35921 - protein, 9 aa, Artificial Sequence
  Description of Artificial Sequence: Synthetic peptide
  Seed: MRLLPLLAL (INS_HUMAN)
MFLLPLLAM

SEQ ID NO: 35922 - protein, 10 aa, Artificial Sequence
  Description of Artificial Sequence: Synthetic peptide
  Seed: MRLLPLLALL (INS_HUMAN)
MILLPLLALM

SEQ ID NO: 35923 - protein, 10 aa, Artificial Sequence
  Description of Artificial Sequence: Synthetic peptide
  Seed: WMRLLPLLAL (INS_HUMAN)
WKRLLPLLAL

SEQ ID NO: 35924 - protein, 10 aa, Artificial Sequence
  Description of Artificial Sequence: Synthetic peptide
  Seed: WMRLLPLLAL (INS_HUMAN)
WCRLLPLLAK

SEQ ID NO: 35925 - protein, 11 aa, Artificial Sequence
  Description of Artificial Sequence: Synthetic peptide
  Seed: WMRLLPLLALL (INS_HUMAN)
WMRLLPLLALI

SEQ ID NO: 35926 - protein, 10 aa, Artificial Sequence
  Description of Artificial Sequence: Synthetic peptide
  Seed: LVCGERGFFY (INS_HUMAN)
LMCGERGFFY

SEQ ID NO: 35927 - protein, 10 aa, Artificial Sequence
  Description of Artificial Sequence: Synthetic peptide
  Seed: LLPLLALLAL (INS_HUMAN)
LWPLLALLAL

SEQ ID NO: 35928 - protein, 11 aa, Artificial Sequence
  Description of Artificial Sequence: Synthetic peptide
  Seed: GSHLVEALYLV (INS_HUMAN)
GIHLVEALYLL

SEQ ID NO: 35929 - protein, 10 aa, Artificial Sequence
  Description of Artificial Sequence: Synthetic peptide
  Seed: MRLLPLLALL (INS_HUMAN)
MGLLPLLALI

SEQ ID NO: 35930 - protein, 10 aa, Artificial Sequence
  Description of Artificial Sequence: Synthetic peptide
  Seed: MALWMRLLPL (INS_HUMAN)
MSLWMRLLPV

SEQ ID NO: 35931 - protein, 10 aa, Artificial Sequence
  Description of Artificial Sequence: Synthetic peptide
  Seed: WMRLLPLLAL (INS_HUMAN)
WIRLLPLLAM

SEQ ID NO: 35932 - protein, 10 aa, Artificial Sequence
  Description of Artificial Sequence: Synthetic peptide
  Seed: MALWMRLLPL (INS_HUMAN)
MQLWMRLLPL

SEQ ID NO: 35933 - protein, 10 aa, Artificial Sequence
  Description of Artificial Sequence: Synthetic peptide
  Seed: RLLPLLALLA (INS_HUMAN)
RLLPLLALLR

SEQ ID NO: 35934 - protein, 10 aa, Artificial Sequence
  Description of Artificial Sequence: Synthetic peptide
  Seed: RGFFYTPKTR (INS_HUMAN)
RAFFYTPKTK

SEQ ID NO: 35935 - protein, 10 aa, Artificial Sequence
  Description of Artificial Sequence: Synthetic peptide
  Seed: ICSLYQLENY (INS_HUMAN)
ITSLYQLENW

SEQ ID NO: 35936 - protein, 11 aa, Artificial Sequence
  Description of Artificial Sequence: Synthetic peptide
  Seed: HLVEALYLVCG (INS_HUMAN)
HMVEALYLVCI

SEQ ID NO: 35937 - protein, 10 aa, Artificial Sequence
  Description of Artificial Sequence: Synthetic peptide
  Seed: MRLLPLLALL (INS_HUMAN)
MSLLPLLALM

SEQ ID NO: 35938 - protein, 9 aa, Artificial Sequence
  Description of Artificial Sequence: Synthetic peptide
  Seed: ALWGPDPAA (INS_HUMAN)
AMWGPDPAM

SEQ ID NO: 35939 - protein, 10 aa, Artificial Sequence
  Description of Artificial Sequence: Synthetic peptide
  Seed: MALWMRLLPL (INS_HUMAN)
MTLWMRLLPV

SEQ ID NO: 35940 - protein, 10 aa, Artificial Sequence
  Description of Artificial Sequence: Synthetic peptide
  Seed: SHLVEALYLV (INS_HUMAN)
SRLVEALYLL

SEQ ID NO: 35941 - protein, 9 aa, Artificial Sequence
  Description of Artificial Sequence: Synthetic peptide
  Seed: TSICSLYQL (INS_HUMAN)
TAICSLYQM

SEQ ID NO: 35942 - protein, 9 aa, Artificial Sequence
  Description of Artificial Sequence: Synthetic peptide
  Seed: ALWGPDPAA (INS_HUMAN)
ATWGPDPAV

SEQ ID NO: 35943 - protein, 9 aa, Artificial Sequence
  Description of Artificial Sequence: Synthetic peptide
  Seed: WGPDPAAAF (INS_HUMAN)
WQPDPAAAL

SEQ ID NO: 35944 - protein, 10 aa, Artificial Sequence
  Description of Artificial Sequence: Synthetic peptide
  Seed: SHLVEALYLV (INS_HUMAN)
SVLVEALYLL

SEQ ID NO: 35945 - protein, 11 aa, Artificial Sequence
  Description of Artificial Sequence: Synthetic peptide
  Seed: GSHLVEALYLV (INS_HUMAN)
GQHLVEALYLL

SEQ ID NO: 35946 - protein, 9 aa, Artificial Sequence
  Description of Artificial Sequence: Synthetic peptide
  Seed: AAAFVNQHL (INS_HUMAN)
ALAFVNQHW

SEQ ID NO: 35947 - protein, 11 aa, Artificial Sequence
  Description of Artificial Sequence: Synthetic peptide
  Seed: REAEDLQVGQV (INS_HUMAN)
RMAEDLQVGQI

SEQ ID NO: 35948 - protein, 11 aa, Artificial Sequence
  Description of Artificial Sequence: Synthetic peptide
  Seed: RGFFYTPKTRR (INS_HUMAN)
RYFFYTPKTRK

SEQ ID NO: 35949 - protein, 9 aa, Artificial Sequence
  Description of Artificial Sequence: Synthetic peptide
  Seed: HLVEALYLV (INS_HUMAN)
HSVEALYLR

SEQ ID NO: 35950 - protein, 11 aa, Artificial Sequence
  Description of Artificial Sequence: Synthetic peptide
  Seed: RGFFYTPKTRR (INS_HUMAN)
RCFFYTPKTRR

SEQ ID NO: 35951 - protein, 9 aa, Artificial Sequence
  Description of Artificial Sequence: Synthetic peptide
  Seed: RLLPLLALL (INS_HUMAN)
RWLPLLALL

SEQ ID NO: 35952 - protein, 10 aa, Artificial Sequence
  Description of Artificial Sequence: Synthetic peptide
  Seed: VNQHLCGSHL (INS_HUMAN)
VPQHLCGSHF

SEQ ID NO: 35953 - protein, 9 aa, Artificial Sequence
  Description of Artificial Sequence: Synthetic peptide
  Seed: HLVEALYLV (INS_HUMAN)
HQVEALYLF

SEQ ID NO: 35954 - protein, 9 aa, Artificial Sequence
  Description of Artificial Sequence: Synthetic peptide
  Seed: ALYLVCGER (INS_HUMAN)
ASYLVCGER

SEQ ID NO: 35955 - protein, 11 aa, Artificial Sequence
  Description of Artificial Sequence: Synthetic peptide
  Seed: MALWMRLLPLL (INS_HUMAN)
MALWMRLLPLF

SEQ ID NO: 35956 - protein, 9 aa, Artificial Sequence
  Description of Artificial Sequence: Synthetic peptide
  Seed: AAAFVNQHL (INS_HUMAN)
AIAFVNQHI

SEQ ID NO: 35957 - protein, 10 aa, Artificial Sequence
  Description of Artificial Sequence: Synthetic peptide
  Seed: EDLQVGQVEL (INS_HUMAN)
EELQVGQVEV

SEQ ID NO: 35958 - protein, 9 aa, Artificial Sequence
  Description of Artificial Sequence: Synthetic peptide
  Seed: MRLLPLLAL (INS_HUMAN)
MELLPLLAY

SEQ ID NO: 35959 - protein, 11 aa, Artificial Sequence
  Description of Artificial Sequence: Synthetic peptide
  Seed: MALWMRLLPLL (INS_HUMAN)
MQLWMRLLPLV

SEQ ID NO: 35960 - protein, 11 aa, Artificial Sequence
  Description of Artificial Sequence: Synthetic peptide
  Seed: GSHLVEALYLV (INS_HUMAN)
GCHLVEALYLI

SEQ ID NO: 35961 - protein, 10 aa, Artificial Sequence
  Description of Artificial Sequence: Synthetic peptide
  Seed: CTSICSLYQL (INS_HUMAN)
CTSICSLYQV

SEQ ID NO: 35962 - protein, 8 aa, Artificial Sequence
  Description of Artificial Sequence: Synthetic peptide
  Seed: GPDPAAAF (INS_HUMAN)
GMDPAAAL

SEQ ID NO: 35963 - protein, 10 aa, Artificial Sequence
  Description of Artificial Sequence: Synthetic peptide
  Seed: SHLVEALYLV (INS_HUMAN)
SQLVEALYLM

SEQ ID NO: 35964 - protein, 11 aa, Artificial Sequence
  Description of Artificial Sequence: Synthetic peptide
  Seed: ALWGPDPAAAF (INS_HUMAN)
APWGPDPAAAY

SEQ ID NO: 35965 - protein, 10 aa, Artificial Sequence
  Description of Artificial Sequence: Synthetic peptide
  Seed: WMRLLPLLAL (INS_HUMAN)
WYRLLPLLAM

SEQ ID NO: 35966 - protein, 9 aa, Artificial Sequence
  Description of Artificial Sequence: Synthetic peptide
  Seed: LLPLLALLA (INS_HUMAN)
LMPLLALLL

SEQ ID NO: 35967 - protein, 10 aa, Artificial Sequence
  Description of Artificial Sequence: Synthetic peptide
  Seed: VNQHLCGSHL (INS_HUMAN)
VVQHLCGSHF

SEQ ID NO: 35968 - protein, 9 aa, Artificial Sequence
  Description of Artificial Sequence: Synthetic peptide
  Seed: MRLLPLLAL (INS_HUMAN)
MRLLPLLAV

SEQ ID NO: 35969 - protein, 9 aa, Artificial Sequence
  Description of Artificial Sequence: Synthetic peptide
  Seed: YLVCGERGF (INS_HUMAN)
YAVCGERGM

SEQ ID NO: 35970 - protein, 9 aa, Artificial Sequence
  Description of Artificial Sequence: Synthetic peptide
  Seed: REAEDLQVG (INS_HUMAN)
REAEDLQVL

SEQ ID NO: 35971 - protein, 10 aa, Artificial Sequence
  Description of Artificial Sequence: Synthetic peptide
  Seed: MALWMRLLPL (INS_HUMAN)
MLLWMRLLPL

SEQ ID NO: 35972 - protein, 9 aa, Artificial Sequence
  Description of Artificial Sequence: Synthetic peptide
  Seed: ALWMRLLPL (INS_HUMAN)
AKWMRLLPI

SEQ ID NO: 35973 - protein, 9 aa, Artificial Sequence
  Description of Artificial Sequence: Synthetic peptide
  Seed: HLVEALYLV (INS_HUMAN)
HIVEALYLA

SEQ ID NO: 35974 - protein, 9 aa, Artificial Sequence
  Description of Artificial Sequence: Synthetic peptide
  Seed: MRLLPLLAL (INS_HUMAN)
MHLLPLLAV

SEQ ID NO: 35975 - protein, 9 aa, Artificial Sequence
  Description of Artificial Sequence: Synthetic peptide
  Seed: AGSLQPLAL (INS_HUMAN)
AMSLQPLAY

SEQ ID NO: 35976 - protein, 9 aa, Artificial Sequence
  Description of Artificial Sequence: Synthetic peptide
  Seed: AGSLQPLAL (INS_HUMAN)
AASLQPLAH

SEQ ID NO: 35977 - protein, 9 aa, Artificial Sequence
  Description of Artificial Sequence: Synthetic peptide
  Seed: AGSLQPLAL (INS_HUMAN)
ALSLQPLAF

SEQ ID NO: 35978 - protein, 10 aa, Artificial Sequence
  Description of Artificial Sequence: Synthetic peptide
  Seed: SHLVEALYLV (INS_HUMAN)
SGLVEALYLI

SEQ ID NO: 35979 - protein, 9 aa, Artificial Sequence
  Description of Artificial Sequence: Synthetic peptide
  Seed: ALYLVCGER (INS_HUMAN)
AMYLVCGER

SEQ ID NO: 35980 - protein, 9 aa, Artificial Sequence
  Description of Artificial Sequence: Synthetic peptide
  Seed: TSICSLYQL (INS_HUMAN)
TSICSLYQA

SEQ ID NO: 35981 - protein, 10 aa, Artificial Sequence
  Description of Artificial Sequence: Synthetic peptide
  Seed: CTSICSLYQL (INS_HUMAN)
CQSICSLYQV

SEQ ID NO: 35982 - protein, 9 aa, Artificial Sequence
  Description of Artificial Sequence: Synthetic peptide
  Seed: TSICSLYQL (INS_HUMAN)
TLICSLYQA

SEQ ID NO: 35983 - protein, 11 aa, Artificial Sequence
  Description of Artificial Sequence: Synthetic peptide
  Seed: REAEDLQVGQV (INS_HUMAN)
REAEDLQVGQF

SEQ ID NO: 35984 - protein, 10 aa, Artificial Sequence
  Description of Artificial Sequence: Synthetic peptide
  Seed: ALWMRLLPLL (INS_HUMAN)
AHWMRLLPLF

SEQ ID NO: 35985 - protein, 9 aa, Artificial Sequence
  Description of Artificial Sequence: Synthetic peptide
  Seed: FVNQHLCGS (INS_HUMAN)
FLNQHLCGM

SEQ ID NO: 35986 - protein, 9 aa, Artificial Sequence
  Description of Artificial Sequence: Synthetic peptide
  Seed: SLYQLENYC (INS_HUMAN)
SLYQLENYM

SEQ ID NO: 35987 - protein, 9 aa, Artificial Sequence
  Description of Artificial Sequence: Synthetic peptide
  Seed: WGPDPAAAF (INS_HUMAN)
WWPDPAAAF

SEQ ID NO: 35988 - protein, 10 aa, Artificial Sequence
  Description of Artificial Sequence: Synthetic peptide
  Seed: MALWMRLLPL (INS_HUMAN)
MDLWMRLLPY

SEQ ID NO: 35989 - protein, 9 aa, Artificial Sequence
  Description of Artificial Sequence: Synthetic peptide
  Seed: HLVEALYLV (INS_HUMAN)
HAVEALYLV

SEQ ID NO: 35990 - protein, 10 aa, Artificial Sequence
  Description of Artificial Sequence: Synthetic peptide
  Seed: LALWGPDPAA (INS_HUMAN)
LCLWGPDPAV

SEQ ID NO: 35991 - protein, 10 aa, Artificial Sequence
  Description of Artificial Sequence: Synthetic peptide
  Seed: RLLPLLALLA (INS_HUMAN)
RLLPLLALLP

SEQ ID NO: 35992 - protein, 10 aa, Artificial Sequence
  Description of Artificial Sequence: Synthetic peptide
  Seed: LLPLLALLAL (INS_HUMAN)
LYPLLALLAY

SEQ ID NO: 35993 - protein, 8 aa, Artificial Sequence
  Description of Artificial Sequence: Synthetic peptide
  Seed: LWMRLLPL (INS_HUMAN)
LKMRLLPL

SEQ ID NO: 35994 - protein, 9 aa, Artificial Sequence
  Description of Artificial Sequence: Synthetic peptide
  Seed: ALWMRLLPL (INS_HUMAN)
APWMRLLPA

SEQ ID NO: 35995 - protein, 11 aa, Artificial Sequence
  Description of Artificial Sequence: Synthetic peptide
  Seed: ALWGPDPAAAF (INS_HUMAN)
AWWGPDPAAAF

SEQ ID NO: 35996 - protein, 10 aa, Artificial Sequence
  Description of Artificial Sequence: Synthetic peptide
  Seed: ALWMRLLPLL (INS_HUMAN)
ARWMRLLPLF

SEQ ID NO: 35997 - protein, 8 aa, Artificial Sequence
  Description of Artificial Sequence: Synthetic peptide
  Seed: LVEALYLV (INS_HUMAN)
LWEALYLV

SEQ ID NO: 35998 - protein, 9 aa, Artificial Sequence
  Description of Artificial Sequence: Synthetic peptide
  Seed: GFFYTPKTR (INS_HUMAN)
GLFYTPKTR

SEQ ID NO: 35999 - protein, 10 aa, Artificial Sequence
  Description of Artificial Sequence: Synthetic peptide
  Seed: WMRLLPLLAL (INS_HUMAN)
WFRLLPLLAK

SEQ ID NO: 36000 - protein, 10 aa, Artificial Sequence
  Description of Artificial Sequence: Synthetic peptide
  Seed: WGPDPAAAFV (INS_HUMAN)
WLPDPAAAFL

SEQ ID NO: 36001 - protein, 9 aa, Artificial Sequence
  Description of Artificial Sequence: Synthetic peptide
  Seed: AAAFVNQHL (INS_HUMAN)
AAAFVNQHI

SEQ ID NO: 36002 - protein, 11 aa, Artificial Sequence
  Description of Artificial Sequence: Synthetic peptide
  Seed: WMRLLPLLALL (INS_HUMAN)
WIRLLPLLALV

SEQ ID NO: 36003 - protein, 9 aa, Artificial Sequence
  Description of Artificial Sequence: Synthetic peptide
  Seed: REAEDLQVG (INS_HUMAN)
REAEDLQVT

SEQ ID NO: 36004 - protein, 10 aa, Artificial Sequence
  Description of Artificial Sequence: Synthetic peptide
  Seed: WMRLLPLLAL (INS_HUMAN)
WFRLLPLLAI

SEQ ID NO: 36005 - protein, 9 aa, Artificial Sequence
  Description of Artificial Sequence: Synthetic peptide
  Seed: LALEGSLQK (INS_HUMAN)
LMLEGSLQR

SEQ ID NO: 36006 - protein, 11 aa, Artificial Sequence
  Description of Artificial Sequence: Synthetic peptide
  Seed: GSHLVEALYLV (INS_HUMAN)
GGHLVEALYLI

SEQ ID NO: 36007 - protein, 10 aa, Artificial Sequence
  Description of Artificial Sequence: Synthetic peptide
  Seed: MRLLPLLALL (INS_HUMAN)
MKLLPLLALV

SEQ ID NO: 36008 - protein, 11 aa, Artificial Sequence
  Description of Artificial Sequence: Synthetic peptide
  Seed: WMRLLPLLALL (INS_HUMAN)
WDRLLPLLALV

SEQ ID NO: 36009 - protein, 10 aa, Artificial Sequence
  Description of Artificial Sequence: Synthetic peptide
  Seed: MALWMRLLPL (INS_HUMAN)
MTLWMRLLPY

SEQ ID NO: 36010 - protein, 10 aa, Artificial Sequence
  Description of Artificial Sequence: Synthetic peptide
  Seed: LLPLLALLAL (INS_HUMAN)
LTPLLALLAL

SEQ ID NO: 36011 - protein, 10 aa, Artificial Sequence
  Description of Artificial Sequence: Synthetic peptide
  Seed: ALWMRLLPLL (INS_HUMAN)
AAWMRLLPLF

SEQ ID NO: 36012 - protein, 9 aa, Artificial Sequence
  Description of Artificial Sequence: Synthetic peptide
  Seed: GSHLVEALY (INS_HUMAN)
GQHLVEALM

SEQ ID NO: 36013 - protein, 9 aa, Artificial Sequence
  Description of Artificial Sequence: Synthetic peptide
  Seed: FVNQHLCGS (INS_HUMAN)
FVNQHLCGI

SEQ ID NO: 36014 - protein, 10 aa, Artificial Sequence
  Description of Artificial Sequence: Synthetic peptide
  Seed: WMRLLPLLAL (INS_HUMAN)
WIRLLPLLAL

SEQ ID NO: 36015 - protein, 11 aa, Artificial Sequence
  Description of Artificial Sequence: Synthetic peptide
  Seed: GSHLVEALYLV (INS_HUMAN)
GPHLVEALYLI

SEQ ID NO: 36016 - protein, 9 aa, Artificial Sequence
  Description of Artificial Sequence: Synthetic peptide
  Seed: LWMRLLPLL (INS_HUMAN)
LTMRLLPLY

SEQ ID NO: 36017 - protein, 10 aa, Artificial Sequence
  Description of Artificial Sequence: Synthetic peptide
  Seed: MALWMRLLPL (INS_HUMAN)
MWLWMRLLPL

SEQ ID NO: 36018 - protein, 9 aa, Artificial Sequence
  Description of Artificial Sequence: Synthetic peptide
  Seed: FVNQHLCGS (INS_HUMAN)
FLNQHLCGI

SEQ ID NO: 36019 - protein, 9 aa, Artificial Sequence
  Description of Artificial Sequence: Synthetic peptide
  Seed: ALWMRLLPL (INS_HUMAN)
AMWMRLLPA

SEQ ID NO: 36020 - protein, 9 aa, Artificial Sequence
  Description of Artificial Sequence: Synthetic peptide
  Seed: REAEDLQVG (INS_HUMAN)
REAEDLQVP

SEQ ID NO: 36021 - protein, 10 aa, Artificial Sequence
  Description of Artificial Sequence: Synthetic peptide
  Seed: ALWMRLLPLL (INS_HUMAN)
AWWMRLLPLF

SEQ ID NO: 36022 - protein, 11 aa, Artificial Sequence
  Description of Artificial Sequence: Synthetic peptide
  Seed: HLVEALYLVCG (INS_HUMAN)
HLVEALYLVCV

SEQ ID NO: 36023 - protein, 11 aa, Artificial Sequence
  Description of Artificial Sequence: Synthetic peptide
  Seed: RGFFYTPKTRR (INS_HUMAN)
RYFFYTPKTRR

SEQ ID NO: 36024 - protein, 11 aa, Artificial Sequence
  Description of Artificial Sequence: Synthetic peptide
  Seed: WMRLLPLLALL (INS_HUMAN)
WPRLLPLLALV

SEQ ID NO: 36025 - protein, 9 aa, Artificial Sequence
  Description of Artificial Sequence: Synthetic peptide
  Seed: AGSLQPLAL (INS_HUMAN)
AASLQPLAF

SEQ ID NO: 36026 - protein, 9 aa, Artificial Sequence
  Description of Artificial Sequence: Synthetic peptide
  Seed: ALWMRLLPL (INS_HUMAN)
AQWMRLLPW

SEQ ID NO: 36027 - protein, 10 aa, Artificial Sequence
  Description of Artificial Sequence: Synthetic peptide
  Seed: LALWGPDPAA (INS_HUMAN)
LELWGPDPAV

SEQ ID NO: 36028 - protein, 10 aa, Artificial Sequence
  Description of Artificial Sequence: Synthetic peptide
  Seed: HLVEALYLVC (INS_HUMAN)
HMVEALYLVG

SEQ ID NO: 36029 - protein, 10 aa, Artificial Sequence
  Description of Artificial Sequence: Synthetic peptide
  Seed: RGFFYTPKTR (INS_HUMAN)
RFFFYTPKTR

SEQ ID NO: 36030 - protein, 9 aa, Artificial Sequence
  Description of Artificial Sequence: Synthetic peptide
  Seed: MRLLPLLAL (INS_HUMAN)
MHLLPLLAI

SEQ ID NO: 36031 - protein, 9 aa, Artificial Sequence
  Description of Artificial Sequence: Synthetic peptide
  Seed: MRLLPLLAL (INS_HUMAN)
MELLPLLAM

SEQ ID NO: 36032 - protein, 9 aa, Artificial Sequence
  Description of Artificial Sequence: Synthetic peptide
  Seed: AAAFVNQHL (INS_HUMAN)
APAFVNQHL

SEQ ID NO: 36033 - protein, 10 aa, Artificial Sequence
  Description of Artificial Sequence: Synthetic peptide
  Seed: MRLLPLLALL (INS_HUMAN)
MFLLPLLALL

SEQ ID NO: 36034 - protein, 10 aa, Artificial Sequence
  Description of Artificial Sequence: Synthetic peptide
  Seed: LWGPDPAAAF (INS_HUMAN)
LVGPDPAAAY

SEQ ID NO: 36035 - protein, 9 aa, Artificial Sequence
  Description of Artificial Sequence: Synthetic peptide
  Seed: MRLLPLLAL (INS_HUMAN)
MTLLPLLAY

SEQ ID NO: 36036 - protein, 9 aa, Artificial Sequence
  Description of Artificial Sequence: Synthetic peptide
  Seed: FFYTPKTRR (INS_HUMAN)
FVYTPKTRK

SEQ ID NO: 36037 - protein, 10 aa, Artificial Sequence
  Description of Artificial Sequence: Synthetic peptide
  Seed: MRLLPLLALL (INS_HUMAN)
MDLLPLLALA

SEQ ID NO: 36038 - protein, 10 aa, Artificial Sequence
  Description of Artificial Sequence: Synthetic peptide
  Seed: SHLVEALYLV (INS_HUMAN)
SYLVEALYLM

SEQ ID NO: 36039 - protein, 9 aa, Artificial Sequence
  Description of Artificial Sequence: Synthetic peptide
  Seed: RLLPLLALL (INS_HUMAN)
RSLPLLALW

SEQ ID NO: 36040 - protein, 9 aa, Artificial Sequence
  Description of Artificial Sequence: Synthetic peptide
  Seed: RLLPLLALL (INS_HUMAN)
RALPLLALR

SEQ ID NO: 36041 - protein, 11 aa, Artificial Sequence
  Description of Artificial Sequence: Synthetic peptide
  Seed: ALWGPDPAAAF (INS_HUMAN)
AVWGPDPAAAR

SEQ ID NO: 36042 - protein, 11 aa, Artificial Sequence
  Description of Artificial Sequence: Synthetic peptide
  Seed: MALWMRLLPLL (INS_HUMAN)
MSLWMRLLPLY

SEQ ID NO: 36043 - protein, 9 aa, Artificial Sequence
  Description of Artificial Sequence: Synthetic peptide
  Seed: ALEGSLQKR (INS_HUMAN)
AAEGSLQKY

SEQ ID NO: 36044 - protein, 9 aa, Artificial Sequence
  Description of Artificial Sequence: Synthetic peptide
  Seed: MRLLPLLAL (INS_HUMAN)
MKLLPLLAI

SEQ ID NO: 36045 - protein, 10 aa, Artificial Sequence
  Description of Artificial Sequence: Synthetic peptide
  Seed: MALWMRLLPL (INS_HUMAN)
MLLWMRLLPA

SEQ ID NO: 36046 - protein, 11 aa, Artificial Sequence
  Description of Artificial Sequence: Synthetic peptide
  Seed: ALWGPDPAAAF (INS_HUMAN)
AYWGPDPAAAY

SEQ ID NO: 36047 - protein, 9 aa, Artificial Sequence
  Description of Artificial Sequence: Synthetic peptide
  Seed: TSICSLYQL (INS_HUMAN)
TCICSLYQW

SEQ ID NO: 36048 - protein, 10 aa, Artificial Sequence
  Description of Artificial Sequence: Synthetic peptide
  Seed: HLCGSHLVEA (INS_HUMAN)
HTCGSHLVEV

SEQ ID NO: 36049 - protein, 9 aa, Artificial Sequence
  Description of Artificial Sequence: Synthetic peptide
  Seed: WGPDPAAAF (INS_HUMAN)
WQPDPAAAY

SEQ ID NO: 36050 - protein, 10 aa, Artificial Sequence
  Description of Artificial Sequence: Synthetic peptide
  Seed: SHLVEALYLV (INS_HUMAN)
SQLVEALYLV

SEQ ID NO: 36051 - protein, 9 aa, Artificial Sequence
  Description of Artificial Sequence: Synthetic peptide
  Seed: RLLPLLALL (INS_HUMAN)
RKLPLLALM

SEQ ID NO: 36052 - protein, 9 aa, Artificial Sequence
  Description of Artificial Sequence: Synthetic peptide
  Seed: CSLYQLENY (INS_HUMAN)
CMLYQLENY

SEQ ID NO: 36053 - protein, 9 aa, Artificial Sequence
  Description of Artificial Sequence: Synthetic peptide
  Seed: YTPKTRREA (INS_HUMAN)
YAPKTRREV

SEQ ID NO: 36054 - protein, 9 aa, Artificial Sequence
  Description of Artificial Sequence: Synthetic peptide
  Seed: WGPDPAAAF (INS_HUMAN)
WFPDPAAAM

SEQ ID NO: 36055 - protein, 10 aa, Artificial Sequence
  Description of Artificial Sequence: Synthetic peptide
  Seed: MALWMRLLPL (INS_HUMAN)
MKLWMRLLPA

SEQ ID NO: 36056 - protein, 10 aa, Artificial Sequence
  Description of Artificial Sequence: Synthetic peptide
  Seed: MRLLPLLALL (INS_HUMAN)
MPLLPLLALL

SEQ ID NO: 36057 - protein, 9 aa, Artificial Sequence
  Description of Artificial Sequence: Synthetic peptide
  Seed: ALWMRLLPL (INS_HUMAN)
AAWMRLLPV

SEQ ID NO: 36058 - protein, 11 aa, Artificial Sequence
  Description of Artificial Sequence: Synthetic peptide
  Seed: ALWGPDPAAAF (INS_HUMAN)
AGWGPDPAAAY

SEQ ID NO: 36059 - protein, 10 aa, Artificial Sequence
  Description of Artificial Sequence: Synthetic peptide
  Seed: WMRLLPLLAL (INS_HUMAN)
WTRLLPLLAK

SEQ ID NO: 36060 - protein, 9 aa, Artificial Sequence
  Description of Artificial Sequence: Synthetic peptide
  Seed: AAAFVNQHL (INS_HUMAN)
ATAFVNQHI

SEQ ID NO: 36061 - protein, 10 aa, Artificial Sequence
  Description of Artificial Sequence: Synthetic peptide
  Seed: HLVEALYLVC (INS_HUMAN)
HLVEALYLVN

SEQ ID NO: 36062 - protein, 8 aa, Artificial Sequence
  Description of Artificial Sequence: Synthetic peptide
  Seed: LVEALYLV (INS_HUMAN)
LLEALYLV

SEQ ID NO: 36063 - protein, 10 aa, Artificial Sequence
  Description of Artificial Sequence: Synthetic peptide
  Seed: HLVEALYLVC (INS_HUMAN)
HLVEALYLVY

SEQ ID NO: 36064 - protein, 9 aa, Artificial Sequence
  Description of Artificial Sequence: Synthetic peptide
  Seed: WGPDPAAAF (INS_HUMAN)
WPPDPAAAW

SEQ ID NO: 36065 - protein, 10 aa, Artificial Sequence
  Description of Artificial Sequence: Synthetic peptide
  Seed: VNQHLCGSHL (INS_HUMAN)
VWQHLCGSHF

SEQ ID NO: 36066 - protein, 9 aa, Artificial Sequence
  Description of Artificial Sequence: Synthetic peptide
  Seed: QHLCGSHLV (INS_HUMAN)
QHLCGSHLA

SEQ ID NO: 36067 - protein, 10 aa, Artificial Sequence
  Description of Artificial Sequence: Synthetic peptide
  Seed: WGPDPAAAFV (INS_HUMAN)
WPPDPAAAFL

SEQ ID NO: 36068 - protein, 10 aa, Artificial Sequence
  Description of Artificial Sequence: Synthetic peptide
  Seed: REAEDLQVGQ (INS_HUMAN)
REAEDLQVGT

SEQ ID NO: 36069 - protein, 9 aa, Artificial Sequence
  Description of Artificial Sequence: Synthetic peptide
  Seed: YTPKTRREA (INS_HUMAN)
YAPKTRREY

SEQ ID NO: 36070 - protein, 9 aa, Artificial Sequence
  Description of Artificial Sequence: Synthetic peptide
  Seed: YTPKTRREA (INS_HUMAN)
YAPKTRREI

SEQ ID NO: 36071 - protein, 10 aa, Artificial Sequence
  Description of Artificial Sequence: Synthetic peptide
  Seed: MRLLPLLALL (INS_HUMAN)
MMLLPLLALV

SEQ ID NO: 36072 - protein, 9 aa, Artificial Sequence
  Description of Artificial Sequence: Synthetic peptide
  Seed: AGSLQPLAL (INS_HUMAN)
AISLQPLAY

SEQ ID NO: 36073 - protein, 9 aa, Artificial Sequence
  Description of Artificial Sequence: Synthetic peptide
  Seed: LALEGSLQK (INS_HUMAN)
LALEGSLQF

SEQ ID NO: 36074 - protein, 11 aa, Artificial Sequence
  Description of Artificial Sequence: Synthetic peptide
  Seed: GSHLVEALYLV (INS_HUMAN)
GEHLVEALYLL

SEQ ID NO: 36075 - protein, 11 aa, Artificial Sequence
  Description of Artificial Sequence: Synthetic peptide
  Seed: ALWGPDPAAAF (INS_HUMAN)
ASWGPDPAAAH

SEQ ID NO: 36076 - protein, 9 aa, Artificial Sequence
  Description of Artificial Sequence: Synthetic peptide
  Seed: VELGGGPGA (INS_HUMAN)
VELGGGPGM

SEQ ID NO: 36077 - protein, 9 aa, Artificial Sequence
  Description of Artificial Sequence: Synthetic peptide
  Seed: GPDPAAAFV (INS_HUMAN)
GFDPAAAFM

SEQ ID NO: 36078 - protein, 9 aa, Artificial Sequence
  Description of Artificial Sequence: Synthetic peptide
  Seed: VCGERGFFY (INS_HUMAN)
VSGERGFFY

SEQ ID NO: 36079 - protein, 11 aa, Artificial Sequence
  Description of Artificial Sequence: Synthetic peptide
  Seed: YLVCGERGFFY (INS_HUMAN)
YFVCGERGFFY

SEQ ID NO: 36080 - protein, 10 aa, Artificial Sequence
  Description of Artificial Sequence: Synthetic peptide
  Seed: MALWMRLLPL (INS_HUMAN)
MFLWMRLLPA

SEQ ID NO: 36081 - protein, 9 aa, Artificial Sequence
  Description of Artificial Sequence: Synthetic peptide
  Seed: GPDPAAAFV (INS_HUMAN)
GGDPAAAFL

SEQ ID NO: 36082 - protein, 10 aa, Artificial Sequence
  Description of Artificial Sequence: Synthetic peptide
  Seed: AEDLQVGQVE (INS_HUMAN)
AEDLQVGQVM

SEQ ID NO: 36083 - protein, 9 aa, Artificial Sequence
  Description of Artificial Sequence: Synthetic peptide
  Seed: AEDLQVGQV (INS_HUMAN)
AVDLQVGQF

SEQ ID NO: 36084 - protein, 9 aa, Artificial Sequence
  Description of Artificial Sequence: Synthetic peptide
  Seed: AAAFVNQHL (INS_HUMAN)
AQAFVNQHI

SEQ ID NO: 36085 - protein, 11 aa, Artificial Sequence
  Description of Artificial Sequence: Synthetic peptide
  Seed: SHLVEALYLVC (INS_HUMAN)
SMLVEALYLVS

SEQ ID NO: 36086 - protein, 9 aa, Artificial Sequence
  Description of Artificial Sequence: Synthetic peptide
  Seed: ALWGPDPAA (INS_HUMAN)
ALWGPDPAR

SEQ ID NO: 36087 - protein, 9 aa, Artificial Sequence
  Description of Artificial Sequence: Synthetic peptide
  Seed: SHLVEALYL (INS_HUMAN)
SRLVEALYF

SEQ ID NO: 36088 - protein, 11 aa, Artificial Sequence
  Description of Artificial Sequence: Synthetic peptide
  Seed: ALWGPDPAAAF (INS_HUMAN)
AIWGPDPAAAL

SEQ ID NO: 36089 - protein, 10 aa, Artificial Sequence
  Description of Artificial Sequence: Synthetic peptide
  Seed: LGGGPGAGSL (INS_HUMAN)
LAGGPGAGSY

SEQ ID NO: 36090 - protein, 9 aa, Artificial Sequence
  Description of Artificial Sequence: Synthetic peptide
  Seed: MRLLPLLAL (INS_HUMAN)
MMLLPLLAL

SEQ ID NO: 36091 - protein, 9 aa, Artificial Sequence
  Description of Artificial Sequence: Synthetic peptide
  Seed: RLLPLLALL (INS_HUMAN)
RFLPLLALL

SEQ ID NO: 36092 - protein, 9 aa, Artificial Sequence
  Description of Artificial Sequence: Synthetic peptide
  Seed: RLLPLLALL (INS_HUMAN)
RILPLLALM

SEQ ID NO: 36093 - protein, 10 aa, Artificial Sequence
  Description of Artificial Sequence: Synthetic peptide
  Seed: HLVEALYLVC (INS_HUMAN)
HLVEALYLVI

SEQ ID NO: 36094 - protein, 9 aa, Artificial Sequence
  Description of Artificial Sequence: Synthetic peptide
  Seed: CGSHLVEAL (INS_HUMAN)
CASHLVEAM

SEQ ID NO: 36095 - protein, 10 aa, Artificial Sequence
  Description of Artificial Sequence: Synthetic peptide
  Seed: EALYLVCGER (INS_HUMAN)
EYLYLVCGER

SEQ ID NO: 36096 - protein, 10 aa, Artificial Sequence
  Description of Artificial Sequence: Synthetic peptide
  Seed: LLPLLALLAL (INS_HUMAN)
LIPLLALLAY

SEQ ID NO: 36097 - protein, 10 aa, Artificial Sequence
  Description of Artificial Sequence: Synthetic peptide
  Seed: VNQHLCGSHL (INS_HUMAN)
VHQHLCGSHF

SEQ ID NO: 36098 - protein, 9 aa, Artificial Sequence
  Description of Artificial Sequence: Synthetic peptide
  Seed: RLLPLLALL (INS_HUMAN)
RKLPLLALL

SEQ ID NO: 36099 - protein, 10 aa, Artificial Sequence
  Description of Artificial Sequence: Synthetic peptide
  Seed: LLPLLALLAL (INS_HUMAN)
LCPLLALLAY

SEQ ID NO: 36100 - protein, 10 aa, Artificial Sequence
  Description of Artificial Sequence: Synthetic peptide
  Seed: REAEDLQVGQ (INS_HUMAN)
REAEDLQVGI

SEQ ID NO: 36101 - protein, 9 aa, Artificial Sequence
  Description of Artificial Sequence: Synthetic peptide
  Seed: REAEDLQVG (INS_HUMAN)
REAEDLQVM

SEQ ID NO: 36102 - protein, 8 aa, Artificial Sequence
  Description of Artificial Sequence: Synthetic peptide
  Seed: GPDPAAAF (INS_HUMAN)
GIDPAAAI

SEQ ID NO: 36103 - protein, 10 aa, Artificial Sequence
  Description of Artificial Sequence: Synthetic peptide
  Seed: LLPLLALLAL (INS_HUMAN)
LVPLLALLAL

SEQ ID NO: 36104 - protein, 9 aa, Artificial Sequence
  Description of Artificial Sequence: Synthetic peptide
  Seed: NQHLCGSHL (INS_HUMAN)
NQHLCGSHM

SEQ ID NO: 36105 - protein, 10 aa, Artificial Sequence
  Description of Artificial Sequence: Synthetic peptide
  Seed: SHLVEALYLV (INS_HUMAN)
SILVEALYLM

SEQ ID NO: 36106 - protein, 10 aa, Artificial Sequence
  Description of Artificial Sequence: Synthetic peptide
  Seed: LALWGPDPAA (INS_HUMAN)
LMLWGPDPAI

SEQ ID NO: 36107 - protein, 8 aa, Artificial Sequence
  Description of Artificial Sequence: Synthetic peptide
  Seed: GPDPAAAF (INS_HUMAN)
GTDPAAAL

SEQ ID NO: 36108 - protein, 10 aa, Artificial Sequence
  Description of Artificial Sequence: Synthetic peptide
  Seed: RGFFYTPKTR (INS_HUMAN)
RTFFYTPKTR

SEQ ID NO: 36109 - protein, 10 aa, Artificial Sequence
  Description of Artificial Sequence: Synthetic peptide
  Seed: SHLVEALYLV (INS_HUMAN)
SVLVEALYLI

SEQ ID NO: 36110 - protein, 10 aa, Artificial Sequence
  Description of Artificial Sequence: Synthetic peptide
  Seed: MALWMRLLPL (INS_HUMAN)
MELWMRLLPA

SEQ ID NO: 36111 - protein, 10 aa, Artificial Sequence
  Description of Artificial Sequence: Synthetic peptide
  Seed: MALWMRLLPL (INS_HUMAN)
MCLWMRLLPI

SEQ ID NO: 36112 - protein, 9 aa, Artificial Sequence
  Description of Artificial Sequence: Synthetic peptide
  Seed: NQHLCGSHL (INS_HUMAN)
NKHLCGSHF

SEQ ID NO: 36113 - protein, 10 aa, Artificial Sequence
  Description of Artificial Sequence: Synthetic peptide
  Seed: MALWMRLLPL (INS_HUMAN)
MILWMRLLPF

SEQ ID NO: 36114 - protein, 10 aa, Artificial Sequence
  Description of Artificial Sequence: Synthetic peptide
  Seed: VNQHLCGSHL (INS_HUMAN)
VYQHLCGSHY

SEQ ID NO: 36115 - protein, 9 aa, Artificial Sequence
  Description of Artificial Sequence: Synthetic peptide
  Seed: AGSLQPLAL (INS_HUMAN)
AASLQPLAV

SEQ ID NO: 36116 - protein, 10 aa, Artificial Sequence
  Description of Artificial Sequence: Synthetic peptide
  Seed: LALWGPDPAA (INS_HUMAN)
LPLWGPDPAA

SEQ ID NO: 36117 - protein, 9 aa, Artificial Sequence
  Description of Artificial Sequence: Synthetic peptide
  Seed: RLLPLLALL (INS_HUMAN)
RKLPLLALY

SEQ ID NO: 36118 - protein, 9 aa, Artificial Sequence
  Description of Artificial Sequence: Synthetic peptide
  Seed: MALWMRLLP (INS_HUMAN)
MPLWMRLLP

SEQ ID NO: 36119 - protein, 9 aa, Artificial Sequence
  Description of Artificial Sequence: Synthetic peptide
  Seed: LVCGERGFF (INS_HUMAN)
LACGERGFW

SEQ ID NO: 36120 - protein, 10 aa, Artificial Sequence
  Description of Artificial Sequence: Synthetic peptide
  Seed: LQPLALEGSL (INS_HUMAN)
LQPLALEGSY

SEQ ID NO: 36121 - protein, 10 aa, Artificial Sequence
  Description of Artificial Sequence: Synthetic peptide
  Seed: RLLPLLALLA (INS_HUMAN)
RQLPLLALLV

SEQ ID NO: 36122 - protein, 11 aa, Artificial Sequence
  Description of Artificial Sequence: Synthetic peptide
  Seed: GSHLVEALYLV (INS_HUMAN)
GCHLVEALYLL

SEQ ID NO: 36123 - protein, 9 aa, Artificial Sequence
  Description of Artificial Sequence: Synthetic peptide
  Seed: WGPDPAAAF (INS_HUMAN)
WAPDPAAAY

SEQ ID NO: 36124 - protein, 9 aa, Artificial Sequence
  Description of Artificial Sequence: Synthetic peptide
  Seed: LALWGPDPA (INS_HUMAN)
LILWGPDPV

SEQ ID NO: 36125 - protein, 9 aa, Artificial Sequence
  Description of Artificial Sequence: Synthetic peptide
  Seed: GPDPAAAFV (INS_HUMAN)
GCDPAAAFM

SEQ ID NO: 36126 - protein, 9 aa, Artificial Sequence
  Description of Artificial Sequence: Synthetic peptide
  Seed: ALWMRLLPL (INS_HUMAN)
AGWMRLLPY

SEQ ID NO: 36127 - protein, 9 aa, Artificial Sequence
  Description of Artificial Sequence: Synthetic peptide
  Seed: HLVEALYLV (INS_HUMAN)
HAVEALYLL

SEQ ID NO: 36128 - protein, 9 aa, Artificial Sequence
  Description of Artificial Sequence: Synthetic peptide
  Seed: LALWGPDPA (INS_HUMAN)
LQLWGPDPI

SEQ ID NO: 36129 - protein, 10 aa, Artificial Sequence
  Description of Artificial Sequence: Synthetic peptide
  Seed: LWGPDPAAAF (INS_HUMAN)
LMGPDPAAAY

SEQ ID NO: 36130 - protein, 10 aa, Artificial Sequence
  Description of Artificial Sequence: Synthetic peptide
  Seed: HLCGSHLVEA (INS_HUMAN)
HVCGSHLVEI

SEQ ID NO: 36131 - protein, 10 aa, Artificial Sequence
  Description of Artificial Sequence: Synthetic peptide
  Seed: LVCGERGFFY (INS_HUMAN)
LTCGERGFFF

SEQ ID NO: 36132 - protein, 9 aa, Artificial Sequence
  Description of Artificial Sequence: Synthetic peptide
  Seed: ALWMRLLPL (INS_HUMAN)
ALWMRLLPC

SEQ ID NO: 36133 - protein, 10 aa, Artificial Sequence
  Description of Artificial Sequence: Synthetic peptide
  Seed: MRLLPLLALL (INS_HUMAN)
MILLPLLALI

SEQ ID NO: 36134 - protein, 10 aa, Artificial Sequence
  Description of Artificial Sequence: Synthetic peptide
  Seed: VNQHLCGSHL (INS_HUMAN)
VFQHLCGSHY

SEQ ID NO: 36135 - protein, 9 aa, Artificial Sequence
  Description of Artificial Sequence: Synthetic peptide
  Seed: RLLPLLALL (INS_HUMAN)
RQLPLLALH

SEQ ID NO: 36136 - protein, 9 aa, Artificial Sequence
  Description of Artificial Sequence: Synthetic peptide
  Seed: RLLPLLALL (INS_HUMAN)
RSLPLLALR

SEQ ID NO: 36137 - protein, 9 aa, Artificial Sequence
  Description of Artificial Sequence: Synthetic peptide
  Seed: GSHLVEALY (INS_HUMAN)
GLHLVEALY

SEQ ID NO: 36138 - protein, 10 aa, Artificial Sequence
  Description of Artificial Sequence: Synthetic peptide
  Seed: EALYLVCGER (INS_HUMAN)
EALYLVCGEK

SEQ ID NO: 36139 - protein, 9 aa, Artificial Sequence
  Description of Artificial Sequence: Synthetic peptide
  Seed: RLLPLLALL (INS_HUMAN)
RALPLLALI

SEQ ID NO: 36140 - protein, 10 aa, Artificial Sequence
  Description of Artificial Sequence: Synthetic peptide
  Seed: MRLLPLLALL (INS_HUMAN)
MTLLPLLALM

SEQ ID NO: 36141 - protein, 10 aa, Artificial Sequence
  Description of Artificial Sequence: Synthetic peptide
  Seed: ALWGPDPAAA (INS_HUMAN)
ATWGPDPAAR

SEQ ID NO: 36142 - protein, 10 aa, Artificial Sequence
  Description of Artificial Sequence: Synthetic peptide
  Seed: HLCGSHLVEA (INS_HUMAN)
HMCGSHLVEM

SEQ ID NO: 36143 - protein, 9 aa, Artificial Sequence
  Description of Artificial Sequence: Synthetic peptide
  Seed: RLLPLLALL (INS_HUMAN)
RRLPLLALI

SEQ ID NO: 36144 - protein, 10 aa, Artificial Sequence
  Description of Artificial Sequence: Synthetic peptide
  Seed: SHLVEALYLV (INS_HUMAN)
SLLVEALYLI

SEQ ID NO: 36145 - protein, 9 aa, Artificial Sequence
  Description of Artificial Sequence: Synthetic peptide
  Seed: TSICSLYQL (INS_HUMAN)
TMICSLYQM

SEQ ID NO: 36146 - protein, 10 aa, Artificial Sequence
  Description of Artificial Sequence: Synthetic peptide
  Seed: ALWGPDPAAA (INS_HUMAN)
AQWGPDPAAL

SEQ ID NO: 36147 - protein, 11 aa, Artificial Sequence
  Description of Artificial Sequence: Synthetic peptide
  Seed: SHLVEALYLVC (INS_HUMAN)
SLLVEALYLVM

SEQ ID NO: 36148 - protein, 9 aa, Artificial Sequence
  Description of Artificial Sequence: Synthetic peptide
  Seed: SLYQLENYC (INS_HUMAN)
SMYQLENYM

SEQ ID NO: 36149 - protein, 10 aa, Artificial Sequence
  Description of Artificial Sequence: Synthetic peptide
  Seed: WMRLLPLLAL (INS_HUMAN)
WKRLLPLLAK

SEQ ID NO: 36150 - protein, 10 aa, Artificial Sequence
  Description of Artificial Sequence: Synthetic peptide
  Seed: ALWMRLLPLL (INS_HUMAN)
ALWMRLLPLV

SEQ ID NO: 36151 - protein, 10 aa, Artificial Sequence
  Description of Artificial Sequence: Synthetic peptide
  Seed: MALWMRLLPL (INS_HUMAN)
MNLWMRLLPL

SEQ ID NO: 36152 - protein, 9 aa, Artificial Sequence
  Description of Artificial Sequence: Synthetic peptide
  Seed: RLLPLLALL (INS_HUMAN)
RRLPLLALF

SEQ ID NO: 36153 - protein, 8 aa, Artificial Sequence
  Description of Artificial Sequence: Synthetic peptide
  Seed: GPDPAAAF (INS_HUMAN)
GIDPAAAM

SEQ ID NO: 36154 - protein, 9 aa, Artificial Sequence
  Description of Artificial Sequence: Synthetic peptide
  Seed: ALWMRLLPL (INS_HUMAN)
AHWMRLLPM

SEQ ID NO: 36155 - protein, 10 aa, Artificial Sequence
  Description of Artificial Sequence: Synthetic peptide
  Seed: MRLLPLLALL (INS_HUMAN)
MMLLPLLALM

SEQ ID NO: 36156 - protein, 10 aa, Artificial Sequence
  Description of Artificial Sequence: Synthetic peptide
  Seed: VNQHLCGSHL (INS_HUMAN)
VRQHLCGSHF

SEQ ID NO: 36157 - protein, 9 aa, Artificial Sequence
  Description of Artificial Sequence: Synthetic peptide
  Seed: GERGFFYTP (INS_HUMAN)
GERGFFYTT

SEQ ID NO: 36158 - protein, 11 aa, Artificial Sequence
  Description of Artificial Sequence: Synthetic peptide
  Seed: RGFFYTPKTRR (INS_HUMAN)
RVFFYTPKTRR

SEQ ID NO: 36159 - protein, 9 aa, Artificial Sequence
  Description of Artificial Sequence: Synthetic peptide
  Seed: SLYQLENYC (INS_HUMAN)
SVYQLENYV

SEQ ID NO: 36160 - protein, 10 aa, Artificial Sequence
  Description of Artificial Sequence: Synthetic peptide
  Seed: SHLVEALYLV (INS_HUMAN)
SRLVEALYLA

SEQ ID NO: 36161 - protein, 9 aa, Artificial Sequence
  Description of Artificial Sequence: Synthetic peptide
  Seed: GPDPAAAFV (INS_HUMAN)
GIDPAAAFV

SEQ ID NO: 36162 - protein, 10 aa, Artificial Sequence
  Description of Artificial Sequence: Synthetic peptide
  Seed: MALWMRLLPL (INS_HUMAN)
MFLWMRLLPL

SEQ ID NO: 36163 - protein, 10 aa, Artificial Sequence
  Description of Artificial Sequence: Synthetic peptide
  Seed: LWMRLLPLLA (INS_HUMAN)
LFMRLLPLLV

SEQ ID NO: 36164 - protein, 9 aa, Artificial Sequence
  Description of Artificial Sequence: Synthetic peptide
  Seed: HLVEALYLV (INS_HUMAN)
HMVEALYLT

SEQ ID NO: 36165 - protein, 10 aa, Artificial Sequence
  Description of Artificial Sequence: Synthetic peptide
  Seed: LLPLLALLAL (INS_HUMAN)
LMPLLALLAV

SEQ ID NO: 36166 - protein, 11 aa, Artificial Sequence
  Description of Artificial Sequence: Synthetic peptide
  Seed: GSHLVEALYLV (INS_HUMAN)
GTHLVEALYLV

SEQ ID NO: 36167 - protein, 10 aa, Artificial Sequence
  Description of Artificial Sequence: Synthetic peptide
  Seed: LWMRLLPLLA (INS_HUMAN)
LLMRLLPLLA

SEQ ID NO: 36168 - protein, 9 aa, Artificial Sequence
  Description of Artificial Sequence: Synthetic peptide
  Seed: GSHLVEALY (INS_HUMAN)
GKHLVEALY

SEQ ID NO: 36169 - protein, 10 aa, Artificial Sequence
  Description of Artificial Sequence: Synthetic peptide
  Seed: RLLPLLALLA (INS_HUMAN)
RLLPLLALLL

SEQ ID NO: 36170 - protein, 10 aa, Artificial Sequence
  Description of Artificial Sequence: Synthetic peptide
  Seed: WGPDPAAAFV (INS_HUMAN)
WQPDPAAAFL

SEQ ID NO: 36171 - protein, 10 aa, Artificial Sequence
  Description of Artificial Sequence: Synthetic peptide
  Seed: MALWMRLLPL (INS_HUMAN)
MHLWMRLLPI

SEQ ID NO: 36172 - protein, 10 aa, Artificial Sequence
  Description of Artificial Sequence: Synthetic peptide
  Seed: WGPDPAAAFV (INS_HUMAN)
WEPDPAAAFL

SEQ ID NO: 36173 - protein, 10 aa, Artificial Sequence
  Description of Artificial Sequence: Synthetic peptide
  Seed: MALWMRLLPL (INS_HUMAN)
MTLWMRLLPM

SEQ ID NO: 36174 - protein, 9 aa, Artificial Sequence
  Description of Artificial Sequence: Synthetic peptide
  Seed: AAAFVNQHL (INS_HUMAN)
AQAFVNQHL

SEQ ID NO: 36175 - protein, 10 aa, Artificial Sequence
  Description of Artificial Sequence: Synthetic peptide
  Seed: ALWGPDPAAA (INS_HUMAN)
AVWGPDPAAL

SEQ ID NO: 36176 - protein, 9 aa, Artificial Sequence
  Description of Artificial Sequence: Synthetic peptide
  Seed: GFFYTPKTR (INS_HUMAN)
GIFYTPKTR

SEQ ID NO: 36177 - protein, 9 aa, Artificial Sequence
  Description of Artificial Sequence: Synthetic peptide
  Seed: RLLPLLALL (INS_HUMAN)
RQLPLLALM

SEQ ID NO: 36178 - protein, 10 aa, Artificial Sequence
  Description of Artificial Sequence: Synthetic peptide
  Seed: ICSLYQLENY (INS_HUMAN)
ISSLYQLENF

SEQ ID NO: 36179 - protein, 10 aa, Artificial Sequence
  Description of Artificial Sequence: Synthetic peptide
  Seed: MALWMRLLPL (INS_HUMAN)
MPLWMRLLPA

SEQ ID NO: 36180 - protein, 11 aa, Artificial Sequence
  Description of Artificial Sequence: Synthetic peptide
  Seed: GGPGAGSLQPL (INS_HUMAN)
GAPGAGSLQPL

SEQ ID NO: 36181 - protein, 11 aa, Artificial Sequence
  Description of Artificial Sequence: Synthetic peptide
  Seed: ALWGPDPAAAF (INS_HUMAN)
ALWGPDPAAAY

SEQ ID NO: 36182 - protein, 11 aa, Artificial Sequence
  Description of Artificial Sequence: Synthetic peptide
  Seed: REAEDLQVGQV (INS_HUMAN)
RQAEDLQVGQL

SEQ ID NO: 36183 - protein, 9 aa, Artificial Sequence
  Description of Artificial Sequence: Synthetic peptide
  Seed: AEDLQVGQV (INS_HUMAN)
ALDLQVGQV

SEQ ID NO: 36184 - protein, 10 aa, Artificial Sequence
  Description of Artificial Sequence: Synthetic peptide
  Seed: WGPDPAAAFV (INS_HUMAN)
WYPDPAAAFL

SEQ ID NO: 36185 - protein, 11 aa, Artificial Sequence
  Description of Artificial Sequence: Synthetic peptide
  Seed: WMRLLPLLALL (INS_HUMAN)
WTRLLPLLALL

SEQ ID NO: 36186 - protein, 11 aa, Artificial Sequence
  Description of Artificial Sequence: Synthetic peptide
  Seed: REAEDLQVGQV (INS_HUMAN)
RQAEDLQVGQI

SEQ ID NO: 36187 - protein, 10 aa, Artificial Sequence
  Description of Artificial Sequence: Synthetic peptide
  Seed: MRLLPLLALL (INS_HUMAN)
MTLLPLLALA

SEQ ID NO: 36188 - protein, 11 aa, Artificial Sequence
  Description of Artificial Sequence: Synthetic peptide
  Seed: GSHLVEALYLV (INS_HUMAN)
GSHLVEALYLL

SEQ ID NO: 36189 - protein, 9 aa, Artificial Sequence
  Description of Artificial Sequence: Synthetic peptide
  Seed: GPDPAAAFV (INS_HUMAN)
GYDPAAAFL

SEQ ID NO: 36190 - protein, 10 aa, Artificial Sequence
  Description of Artificial Sequence: Synthetic peptide
  Seed: SHLVEALYLV (INS_HUMAN)
SSLVEALYLI

SEQ ID NO: 36191 - protein, 10 aa, Artificial Sequence
  Description of Artificial Sequence: Synthetic peptide
  Seed: SHLVEALYLV (INS_HUMAN)
SPLVEALYLL

SEQ ID NO: 36192 - protein, 8 aa, Artificial Sequence
  Description of Artificial Sequence: Synthetic peptide
  Seed: GPDPAAAF (INS_HUMAN)
GADPAAAF

SEQ ID NO: 36193 - protein, 11 aa, Artificial Sequence
  Description of Artificial Sequence: Synthetic peptide
  Seed: REAEDLQVGQV (INS_HUMAN)
RLAEDLQVGQM

SEQ ID NO: 36194 - protein, 11 aa, Artificial Sequence
  Description of Artificial Sequence: Synthetic peptide
  Seed: MALWMRLLPLL (INS_HUMAN)
MWLWMRLLPLF

SEQ ID NO: 36195 - protein, 10 aa, Artificial Sequence
  Description of Artificial Sequence: Synthetic peptide
  Seed: MRLLPLLALL (INS_HUMAN)
MILLPLLALL

SEQ ID NO: 36196 - protein, 9 aa, Artificial Sequence
  Description of Artificial Sequence: Synthetic peptide
  Seed: HLVEALYLV (INS_HUMAN)
HAVEALYLR

SEQ ID NO: 36197 - protein, 10 aa, Artificial Sequence
  Description of Artificial Sequence: Synthetic peptide
  Seed: LVCGERGFFY (INS_HUMAN)
LYCGERGFFY

SEQ ID NO: 36198 - protein, 10 aa, Artificial Sequence
  Description of Artificial Sequence: Synthetic peptide
  Seed: MRLLPLLALL (INS_HUMAN)
MYLLPLLALI

SEQ ID NO: 36199 - protein, 9 aa, Artificial Sequence
  Description of Artificial Sequence: Synthetic peptide
  Seed: LVCGERGFF (INS_HUMAN)
LTCGERGFW

SEQ ID NO: 36200 - protein, 10 aa, Artificial Sequence
  Description of Artificial Sequence: Synthetic peptide
  Seed: SHLVEALYLV (INS_HUMAN)
SALVEALYLM

SEQ ID NO: 36201 - protein, 10 aa, Artificial Sequence
  Description of Artificial Sequence: Synthetic peptide
  Seed: LALWGPDPAA (INS_HUMAN)
LILWGPDPAV

SEQ ID NO: 36202 - protein, 9 aa, Artificial Sequence
  Description of Artificial Sequence: Synthetic peptide
  Seed: RLLPLLALL (INS_HUMAN)
RMLPLLALM

SEQ ID NO: 36203 - protein, 10 aa, Artificial Sequence
  Description of Artificial Sequence: Synthetic peptide
  Seed: RGFFYTPKTR (INS_HUMAN)
RQFFYTPKTR

SEQ ID NO: 36204 - protein, 9 aa, Artificial Sequence
  Description of Artificial Sequence: Synthetic peptide
  Seed: AAFVNQHLC (INS_HUMAN)
ATFVNQHLV

SEQ ID NO: 36205 - protein, 9 aa, Artificial Sequence
  Description of Artificial Sequence: Synthetic peptide
  Seed: FFYTPKTRR (INS_HUMAN)
FSYTPKTRK

SEQ ID NO: 36206 - protein, 9 aa, Artificial Sequence
  Description of Artificial Sequence: Synthetic peptide
  Seed: FVNQHLCGS (INS_HUMAN)
FQNQHLCGA

SEQ ID NO: 36207 - protein, 9 aa, Artificial Sequence
  Description of Artificial Sequence: Synthetic peptide
  Seed: RLLPLLALL (INS_HUMAN)
RALPLLALF

SEQ ID NO: 36208 - protein, 9 aa, Artificial Sequence
  Description of Artificial Sequence: Synthetic peptide
  Seed: GPDPAAAFV (INS_HUMAN)
GSDPAAAFL

SEQ ID NO: 36209 - protein, 9 aa, Artificial Sequence
  Description of Artificial Sequence: Synthetic peptide
  Seed: LALEGSLQK (INS_HUMAN)
LSLEGSLQK

SEQ ID NO: 36210 - protein, 9 aa, Artificial Sequence
  Description of Artificial Sequence: Synthetic peptide
  Seed: MRLLPLLAL (INS_HUMAN)
MTLLPLLAM

SEQ ID NO: 36211 - protein, 9 aa, Artificial Sequence
  Description of Artificial Sequence: Synthetic peptide
  Seed: AGSLQPLAL (INS_HUMAN)
AQSLQPLAY

SEQ ID NO: 36212 - protein, 9 aa, Artificial Sequence
  Description of Artificial Sequence: Synthetic peptide
  Seed: ALWMRLLPL (INS_HUMAN)
AQWMRLLPF

SEQ ID NO: 36213 - protein, 10 aa, Artificial Sequence
  Description of Artificial Sequence: Synthetic peptide
  Seed: VELGGGPGAG (INS_HUMAN)
VELGGGPGAV

SEQ ID NO: 36214 - protein, 10 aa, Artificial Sequence
  Description of Artificial Sequence: Synthetic peptide
  Seed: LLPLLALLAL (INS_HUMAN)
LEPLLALLAL

SEQ ID NO: 36215 - protein, 9 aa, Artificial Sequence
  Description of Artificial Sequence: Synthetic peptide
  Seed: RLLPLLALL (INS_HUMAN)
RHLPLLALF

SEQ ID NO: 36216 - protein, 10 aa, Artificial Sequence
  Description of Artificial Sequence: Synthetic peptide
  Seed: RGFFYTPKTR (INS_HUMAN)
RWFFYTPKTK

SEQ ID NO: 36217 - protein, 10 aa, Artificial Sequence
  Description of Artificial Sequence: Synthetic peptide
  Seed: VNQHLCGSHL (INS_HUMAN)
VAQHLCGSHF

SEQ ID NO: 36218 - protein, 10 aa, Artificial Sequence
  Description of Artificial Sequence: Synthetic peptide
  Seed: SHLVEALYLV (INS_HUMAN)
SILVEALYLA

SEQ ID NO: 36219 - protein, 9 aa, Artificial Sequence
  Description of Artificial Sequence: Synthetic peptide
  Seed: VCGERGFFY (INS_HUMAN)
VFGERGFFY

SEQ ID NO: 36220 - protein, 9 aa, Artificial Sequence
  Description of Artificial Sequence: Synthetic peptide
  Seed: AAAFVNQHL (INS_HUMAN)
AIAFVNQHF

SEQ ID NO: 36221 - protein, 10 aa, Artificial Sequence
  Description of Artificial Sequence: Synthetic peptide
  Seed: SHLVEALYLV (INS_HUMAN)
SGLVEALYLM

SEQ ID NO: 36222 - protein, 9 aa, Artificial Sequence
  Description of Artificial Sequence: Synthetic peptide
  Seed: MRLLPLLAL (INS_HUMAN)
MMLLPLLAY

SEQ ID NO: 36223 - protein, 10 aa, Artificial Sequence
  Description of Artificial Sequence: Synthetic peptide
  Seed: LALWGPDPAA (INS_HUMAN)
LMLWGPDPAV

SEQ ID NO: 36224 - protein, 10 aa, Artificial Sequence
  Description of Artificial Sequence: Synthetic peptide
  Seed: WMRLLPLLAL (INS_HUMAN)
WKRLLPLLAF

SEQ ID NO: 36225 - protein, 9 aa, Artificial Sequence
  Description of Artificial Sequence: Synthetic peptide
  Seed: RLLPLLALL (INS_HUMAN)
RYLPLLALK

SEQ ID NO: 36226 - protein, 10 aa, Artificial Sequence
  Description of Artificial Sequence: Synthetic peptide
  Seed: LLPLLALLAL (INS_HUMAN)
LYPLLALLAL

SEQ ID NO: 36227 - protein, 10 aa, Artificial Sequence
  Description of Artificial Sequence: Synthetic peptide
  Seed: WMRLLPLLAL (INS_HUMAN)
WARLLPLLAY

SEQ ID NO: 36228 - protein, 10 aa, Artificial Sequence
  Description of Artificial Sequence: Synthetic peptide
  Seed: MALWMRLLPL (INS_HUMAN)
MLLWMRLLPT

SEQ ID NO: 36229 - protein, 10 aa, Artificial Sequence
  Description of Artificial Sequence: Synthetic peptide
  Seed: MRLLPLLALL (INS_HUMAN)
MELLPLLALV

SEQ ID NO: 36230 - protein, 9 aa, Artificial Sequence
  Description of Artificial Sequence: Synthetic peptide
  Seed: LALEGSLQK (INS_HUMAN)
LTLEGSLQM

SEQ ID NO: 36231 - protein, 10 aa, Artificial Sequence
  Description of Artificial Sequence: Synthetic peptide
  Seed: MALWMRLLPL (INS_HUMAN)
MGLWMRLLPY

SEQ ID NO: 36232 - protein, 9 aa, Artificial Sequence
  Description of Artificial Sequence: Synthetic peptide
  Seed: HLVEALYLV (INS_HUMAN)
HLVEALYLI

SEQ ID NO: 36233 - protein, 9 aa, Artificial Sequence
  Description of Artificial Sequence: Synthetic peptide
  Seed: WGPDPAAAF (INS_HUMAN)
WMPDPAAAV

SEQ ID NO: 36234 - protein, 11 aa, Artificial Sequence
  Description of Artificial Sequence: Synthetic peptide
  Seed: RLLPLLALLAL (INS_HUMAN)
RQLPLLALLAV

SEQ ID NO: 36235 - protein, 9 aa, Artificial Sequence
  Description of Artificial Sequence: Synthetic peptide
  Seed: GSHLVEALY (INS_HUMAN)
GSHLVEALF

SEQ ID NO: 36236 - protein, 9 aa, Artificial Sequence
  Description of Artificial Sequence: Synthetic peptide
  Seed: AAAFVNQHL (INS_HUMAN)
AVAFVNQHA

SEQ ID NO: 36237 - protein, 9 aa, Artificial Sequence
  Description of Artificial Sequence: Synthetic peptide
  Seed: TSICSLYQL (INS_HUMAN)
TMICSLYQV

SEQ ID NO: 36238 - protein, 10 aa, Artificial Sequence
  Description of Artificial Sequence: Synthetic peptide
  Seed: MALWMRLLPL (INS_HUMAN)
MDLWMRLLPV

SEQ ID NO: 36239 - protein, 10 aa, Artificial Sequence
  Description of Artificial Sequence: Synthetic peptide
  Seed: LWMRLLPLLA (INS_HUMAN)
LLMRLLPLLV

SEQ ID NO: 36240 - protein, 10 aa, Artificial Sequence
  Description of Artificial Sequence: Synthetic peptide
  Seed: SHLVEALYLV (INS_HUMAN)
SALVEALYLV

SEQ ID NO: 36241 - protein, 10 aa, Artificial Sequence
  Description of Artificial Sequence: Synthetic peptide
  Seed: AEDLQVGQVE (INS_HUMAN)
AEDLQVGQVT

SEQ ID NO: 36242 - protein, 10 aa, Artificial Sequence
  Description of Artificial Sequence: Synthetic peptide
  Seed: HLCGSHLVEA (INS_HUMAN)
HMCGSHLVEA

SEQ ID NO: 36243 - protein, 11 aa, Artificial Sequence
  Description of Artificial Sequence: Synthetic peptide
  Seed: LALWGPDPAAA (INS_HUMAN)
LPLWGPDPAAA

SEQ ID NO: 36244 - protein, 9 aa, Artificial Sequence
  Description of Artificial Sequence: Synthetic peptide
  Seed: SHLVEALYL (INS_HUMAN)
SRLVEALYY

SEQ ID NO: 36245 - protein, 10 aa, Artificial Sequence
  Description of Artificial Sequence: Synthetic peptide
  Seed: SHLVEALYLV (INS_HUMAN)
SFLVEALYLM

SEQ ID NO: 36246 - protein, 11 aa, Artificial Sequence
  Description of Artificial Sequence: Synthetic peptide
  Seed: ALWGPDPAAAF (INS_HUMAN)
AGWGPDPAAAL

SEQ ID NO: 36247 - protein, 10 aa, Artificial Sequence
  Description of Artificial Sequence: Synthetic peptide
  Seed: CTSICSLYQL (INS_HUMAN)
CMSICSLYQI

SEQ ID NO: 36248 - protein, 9 aa, Artificial Sequence
  Description of Artificial Sequence: Synthetic peptide
  Seed: YLVCGERGF (INS_HUMAN)
YAVCGERGF

SEQ ID NO: 36249 - protein, 10 aa, Artificial Sequence
  Description of Artificial Sequence: Synthetic peptide
  Seed: ALWGPDPAAA (INS_HUMAN)
AVWGPDPAAV

SEQ ID NO: 36250 - protein, 9 aa, Artificial Sequence
  Description of Artificial Sequence: Synthetic peptide
  Seed: RLLPLLALL (INS_HUMAN)
RLLPLLALF

SEQ ID NO: 36251 - protein, 10 aa, Artificial Sequence
  Description of Artificial Sequence: Synthetic peptide
  Seed: WMRLLPLLAL (INS_HUMAN)
WARLLPLLAL

SEQ ID NO: 36252 - protein, 10 aa, Artificial Sequence
  Description of Artificial Sequence: Synthetic peptide
  Seed: HLVEALYLVC (INS_HUMAN)
HTVEALYLVV

SEQ ID NO: 36253 - protein, 10 aa, Artificial Sequence
  Description of Artificial Sequence: Synthetic peptide
  Seed: WMRLLPLLAL (INS_HUMAN)
WGRLLPLLAI

SEQ ID NO: 36254 - protein, 11 aa, Artificial Sequence
  Description of Artificial Sequence: Synthetic peptide
  Seed: MALWMRLLPLL (INS_HUMAN)
MYLWMRLLPLF

SEQ ID NO: 36255 - protein, 10 aa, Artificial Sequence
  Description of Artificial Sequence: Synthetic peptide
  Seed: SHLVEALYLV (INS_HUMAN)
SELVEALYLI

SEQ ID NO: 36256 - protein, 8 aa, Artificial Sequence
  Description of Artificial Sequence: Synthetic peptide
  Seed: LWMRLLPL (INS_HUMAN)
LYMRLLPL

SEQ ID NO: 36257 - protein, 9 aa, Artificial Sequence
  Description of Artificial Sequence: Synthetic peptide
  Seed: YTPKTRREA (INS_HUMAN)
YGPKTRREL

SEQ ID NO: 36258 - protein, 8 aa, Artificial Sequence
  Description of Artificial Sequence: Synthetic peptide
  Seed: GPDPAAAF (INS_HUMAN)
GADPAAAL

SEQ ID NO: 36259 - protein, 9 aa, Artificial Sequence
  Description of Artificial Sequence: Synthetic peptide
  Seed: HLVEALYLV (INS_HUMAN)
HVVEALYLA

SEQ ID NO: 36260 - protein, 9 aa, Artificial Sequence
  Description of Artificial Sequence: Synthetic peptide
  Seed: ALEGSLQKR (INS_HUMAN)
AMEGSLQKY

SEQ ID NO: 36261 - protein, 9 aa, Artificial Sequence
  Description of Artificial Sequence: Synthetic peptide
  Seed: LALEGSLQK (INS_HUMAN)
LSLEGSLQL

SEQ ID NO: 36262 - protein, 9 aa, Artificial Sequence
  Description of Artificial Sequence: Synthetic peptide
  Seed: RLLPLLALL (INS_HUMAN)
RLLPLLALT

SEQ ID NO: 36263 - protein, 9 aa, Artificial Sequence
  Description of Artificial Sequence: Synthetic peptide
  Seed: AEDLQVGQV (INS_HUMAN)
AEDLQVGQM

SEQ ID NO: 36264 - protein, 9 aa, Artificial Sequence
  Description of Artificial Sequence: Synthetic peptide
  Seed: AEDLQVGQV (INS_HUMAN)
AFDLQVGQV

SEQ ID NO: 36265 - protein, 9 aa, Artificial Sequence
  Description of Artificial Sequence: Synthetic peptide
  Seed: LALWGPDPA (INS_HUMAN)
LVLWGPDPL

SEQ ID NO: 36266 - protein, 10 aa, Artificial Sequence
  Description of Artificial Sequence: Synthetic peptide
  Seed: SHLVEALYLV (INS_HUMAN)
SALVEALYLI

SEQ ID NO: 36267 - protein, 11 aa, Artificial Sequence
  Description of Artificial Sequence: Synthetic peptide
  Seed: MALWMRLLPLL (INS_HUMAN)
MVLWMRLLPLF

SEQ ID NO: 36268 - protein, 9 aa, Artificial Sequence
  Description of Artificial Sequence: Synthetic peptide
  Seed: WGPDPAAAF (INS_HUMAN)
WSPDPAAAV

SEQ ID NO: 36269 - protein, 9 aa, Artificial Sequence
  Description of Artificial Sequence: Synthetic peptide
  Seed: AAAFVNQHL (INS_HUMAN)
AIAFVNQHA

SEQ ID NO: 36270 - protein, 11 aa, Artificial Sequence
  Description of Artificial Sequence: Synthetic peptide
  Seed: ALWGPDPAAAF (INS_HUMAN)
AMWGPDPAAAK

SEQ ID NO: 36271 - protein, 9 aa, Artificial Sequence
  Description of Artificial Sequence: Synthetic peptide
  Seed: ALWMRLLPL (INS_HUMAN)
AMWMRLLPY

SEQ ID NO: 36272 - protein, 8 aa, Artificial Sequence
  Description of Artificial Sequence: Synthetic peptide
  Seed: LWMRLLPL (INS_HUMAN)
LMMRLLPL

SEQ ID NO: 36273 - protein, 9 aa, Artificial Sequence
  Description of Artificial Sequence: Synthetic peptide
  Seed: TSICSLYQL (INS_HUMAN)
TTICSLYQY

SEQ ID NO: 36274 - protein, 8 aa, Artificial Sequence
  Description of Artificial Sequence: Synthetic peptide
  Seed: LWMRLLPL (INS_HUMAN)
LMMRLLPV

SEQ ID NO: 36275 - protein, 9 aa, Artificial Sequence
  Description of Artificial Sequence: Synthetic peptide
  Seed: RLLPLLALL (INS_HUMAN)
RILPLLALF

SEQ ID NO: 36276 - protein, 10 aa, Artificial Sequence
  Description of Artificial Sequence: Synthetic peptide
  Seed: ALWMRLLPLL (INS_HUMAN)
AGWMRLLPLF

SEQ ID NO: 36277 - protein, 9 aa, Artificial Sequence
  Description of Artificial Sequence: Synthetic peptide
  Seed: ALWMRLLPL (INS_HUMAN)
ATWMRLLPI

SEQ ID NO: 36278 - protein, 11 aa, Artificial Sequence
  Description of Artificial Sequence: Synthetic peptide
  Seed: ALWGPDPAAAF (INS_HUMAN)
AWWGPDPAAAY

SEQ ID NO: 36279 - protein, 9 aa, Artificial Sequence
  Description of Artificial Sequence: Synthetic peptide
  Seed: VCGERGFFY (INS_HUMAN)
VAGERGFFY

SEQ ID NO: 36280 - protein, 9 aa, Artificial Sequence
  Description of Artificial Sequence: Synthetic peptide
  Seed: AAAFVNQHL (INS_HUMAN)
AGAFVNQHW

SEQ ID NO: 36281 - protein, 11 aa, Artificial Sequence
  Description of Artificial Sequence: Synthetic peptide
  Seed: SHLVEALYLVC (INS_HUMAN)
SMLVEALYLVY

SEQ ID NO: 36282 - protein, 9 aa, Artificial Sequence
  Description of Artificial Sequence: Synthetic peptide
  Seed: WGPDPAAAF (INS_HUMAN)
WWPDPAAAL

SEQ ID NO: 36283 - protein, 10 aa, Artificial Sequence
  Description of Artificial Sequence: Synthetic peptide
  Seed: ALWMRLLPLL (INS_HUMAN)
AVWMRLLPLF

SEQ ID NO: 36284 - protein, 9 aa, Artificial Sequence
  Description of Artificial Sequence: Synthetic peptide
  Seed: AEDLQVGQV (INS_HUMAN)
AVDLQVGQI

SEQ ID NO: 36285 - protein, 9 aa, Artificial Sequence
  Description of Artificial Sequence: Synthetic peptide
  Seed: GPDPAAAFV (INS_HUMAN)
GMDPAAAFF

SEQ ID NO: 36286 - protein, 10 aa, Artificial Sequence
  Description of Artificial Sequence: Synthetic peptide
  Seed: YLVCGERGFF (INS_HUMAN)
YMVCGERGFY

SEQ ID NO: 36287 - protein, 9 aa, Artificial Sequence
  Description of Artificial Sequence: Synthetic peptide
  Seed: ALWGPDPAA (INS_HUMAN)
ALWGPDPAM

SEQ ID NO: 36288 - protein, 10 aa, Artificial Sequence
  Description of Artificial Sequence: Synthetic peptide
  Seed: ALWMRLLPLL (INS_HUMAN)
AMWMRLLPLF

SEQ ID NO: 36289 - protein, 9 aa, Artificial Sequence
  Description of Artificial Sequence: Synthetic peptide
  Seed: WGPDPAAAF (INS_HUMAN)
WWPDPAAAY

SEQ ID NO: 36290 - protein, 10 aa, Artificial Sequence
  Description of Artificial Sequence: Synthetic peptide
  Seed: QCCTSICSLY (INS_HUMAN)
QMCTSICSLY

SEQ ID NO: 36291 - protein, 9 aa, Artificial Sequence
  Description of Artificial Sequence: Synthetic peptide
  Seed: ALWMRLLPL (INS_HUMAN)
ALWMRLLPV

SEQ ID NO: 36292 - protein, 9 aa, Artificial Sequence
  Description of Artificial Sequence: Synthetic peptide
  Seed: RLLPLLALL (INS_HUMAN)
RRLPLLALG

SEQ ID NO: 36293 - protein, 11 aa, Artificial Sequence
  Description of Artificial Sequence: Synthetic peptide
  Seed: MALWMRLLPLL (INS_HUMAN)
MTLWMRLLPLY

SEQ ID NO: 36294 - protein, 9 aa, Artificial Sequence
  Description of Artificial Sequence: Synthetic peptide
  Seed: AAAFVNQHL (INS_HUMAN)
ALAFVNQHF

SEQ ID NO: 36295 - protein, 11 aa, Artificial Sequence
  Description of Artificial Sequence: Synthetic peptide
  Seed: RGFFYTPKTRR (INS_HUMAN)
RMFFYTPKTRK

SEQ ID NO: 36296 - protein, 9 aa, Artificial Sequence
  Description of Artificial Sequence: Synthetic peptide
  Seed: LALEGSLQK (INS_HUMAN)
LTLEGSLQL

SEQ ID NO: 36297 - protein, 10 aa, Artificial Sequence
  Description of Artificial Sequence: Synthetic peptide
  Seed: EALYLVCGER (INS_HUMAN)
ETLYLVCGER

SEQ ID NO: 36298 - protein, 10 aa, Artificial Sequence
  Description of Artificial Sequence: Synthetic peptide
  Seed: WMRLLPLLAL (INS_HUMAN)
WVRLLPLLAL

SEQ ID NO: 36299 - protein, 9 aa, Artificial Sequence
  Description of Artificial Sequence: Synthetic peptide
  Seed: ALWMRLLPL (INS_HUMAN)
ASWMRLLPR

SEQ ID NO: 36300 - protein, 10 aa, Artificial Sequence
  Description of Artificial Sequence: Synthetic peptide
  Seed: WMRLLPLLAL (INS_HUMAN)
WHRLLPLLAY

SEQ ID NO: 36301 - protein, 9 aa, Artificial Sequence
  Description of Artificial Sequence: Synthetic peptide
  Seed: ALYLVCGER (INS_HUMAN)
AVYLVCGER

SEQ ID NO: 36302 - protein, 10 aa, Artificial Sequence
  Description of Artificial Sequence: Synthetic peptide
  Seed: RLLPLLALLA (INS_HUMAN)
RALPLLALLV

SEQ ID NO: 36303 - protein, 10 aa, Artificial Sequence
  Description of Artificial Sequence: Synthetic peptide
  Seed: SHLVEALYLV (INS_HUMAN)
SDLVEALYLV

SEQ ID NO: 36304 - protein, 11 aa, Artificial Sequence
  Description of Artificial Sequence: Synthetic peptide
  Seed: MALWMRLLPLL (INS_HUMAN)
MLLWMRLLPLF

SEQ ID NO: 36305 - protein, 8 aa, Artificial Sequence
  Description of Artificial Sequence: Synthetic peptide
  Seed: AAFVNQHL (INS_HUMAN)
AQFVNQHL

SEQ ID NO: 36306 - protein, 9 aa, Artificial Sequence
  Description of Artificial Sequence: Synthetic peptide
  Seed: TSICSLYQL (INS_HUMAN)
TIICSLYQW

SEQ ID NO: 36307 - protein, 9 aa, Artificial Sequence
  Description of Artificial Sequence: Synthetic peptide
  Seed: ALYLVCGER (INS_HUMAN)
AMYLVCGEK

SEQ ID NO: 36308 - protein, 9 aa, Artificial Sequence
  Description of Artificial Sequence: Synthetic peptide
  Seed: FFYTPKTRR (INS_HUMAN)
FLYTPKTRK

SEQ ID NO: 36309 - protein, 9 aa, Artificial Sequence
  Description of Artificial Sequence: Synthetic peptide
  Seed: TSICSLYQL (INS_HUMAN)
TAICSLYQF

SEQ ID NO: 36310 - protein, 10 aa, Artificial Sequence
  Description of Artificial Sequence: Synthetic peptide
  Seed: MRLLPLLALL (INS_HUMAN)
MSLLPLLALI

SEQ ID NO: 36311 - protein, 10 aa, Artificial Sequence
  Description of Artificial Sequence: Synthetic peptide
  Seed: WMRLLPLLAL (INS_HUMAN)
WCRLLPLLAI

SEQ ID NO: 36312 - protein, 9 aa, Artificial Sequence
  Description of Artificial Sequence: Synthetic peptide
  Seed: RLLPLLALL (INS_HUMAN)
RMLPLLALF

SEQ ID NO: 36313 - protein, 9 aa, Artificial Sequence
  Description of Artificial Sequence: Synthetic peptide
  Seed: MRLLPLLAL (INS_HUMAN)
MRLLPLLAI

SEQ ID NO: 36314 - protein, 10 aa, Artificial Sequence
  Description of Artificial Sequence: Synthetic peptide
  Seed: SHLVEALYLV (INS_HUMAN)
SMLVEALYLL

SEQ ID NO: 36315 - protein, 11 aa, Artificial Sequence
  Description of Artificial Sequence: Synthetic peptide
  Seed: REAEDLQVGQV (INS_HUMAN)
RLAEDLQVGQF

SEQ ID NO: 36316 - protein, 10 aa, Artificial Sequence
  Description of Artificial Sequence: Synthetic peptide
  Seed: MALWMRLLPL (INS_HUMAN)
MILWMRLLPY

SEQ ID NO: 36317 - protein, 8 aa, Artificial Sequence
  Description of Artificial Sequence: Synthetic peptide
  Seed: RGFFYTPK (INS_HUMAN)
RTFFYTPR

SEQ ID NO: 36318 - protein, 9 aa, Artificial Sequence
  Description of Artificial Sequence: Synthetic peptide
  Seed: WMRLLPLLA (INS_HUMAN)
WSRLLPLLK

SEQ ID NO: 36319 - protein, 9 aa, Artificial Sequence
  Description of Artificial Sequence: Synthetic peptide
  Seed: AAFVNQHLC (INS_HUMAN)
ASFVNQHLF

SEQ ID NO: 36320 - protein, 9 aa, Artificial Sequence
  Description of Artificial Sequence: Synthetic peptide
  Seed: RLLPLLALL (INS_HUMAN)
RYLPLLALI

SEQ ID NO: 36321 - protein, 9 aa, Artificial Sequence
  Description of Artificial Sequence: Synthetic peptide
  Seed: RLLPLLALL (INS_HUMAN)
RNLPLLALW

SEQ ID NO: 36322 - protein, 9 aa, Artificial Sequence
  Description of Artificial Sequence: Synthetic peptide
  Seed: YTPKTRREA (INS_HUMAN)
YVPKTRREY

SEQ ID NO: 36323 - protein, 9 aa, Artificial Sequence
  Description of Artificial Sequence: Synthetic peptide
  Seed: WGPDPAAAF (INS_HUMAN)
WSPDPAAAL

SEQ ID NO: 36324 - protein, 9 aa, Artificial Sequence
  Description of Artificial Sequence: Synthetic peptide
  Seed: MALWMRLLP (INS_HUMAN)
MPLWMRLLT

SEQ ID NO: 36325 - protein, 9 aa, Artificial Sequence
  Description of Artificial Sequence: Synthetic peptide
  Seed: YTPKTRREA (INS_HUMAN)
YSPKTRREF

SEQ ID NO: 36326 - protein, 9 aa, Artificial Sequence
  Description of Artificial Sequence: Synthetic peptide
  Seed: TSICSLYQL (INS_HUMAN)
TQICSLYQW

SEQ ID NO: 36327 - protein, 11 aa, Artificial Sequence
  Description of Artificial Sequence: Synthetic peptide
  Seed: SHLVEALYLVC (INS_HUMAN)
SMLVEALYLVV

SEQ ID NO: 36328 - protein, 9 aa, Artificial Sequence
  Description of Artificial Sequence: Synthetic peptide
  Seed: GPDPAAAFV (INS_HUMAN)
GFDPAAAFV

SEQ ID NO: 36329 - protein, 9 aa, Artificial Sequence
  Description of Artificial Sequence: Synthetic peptide
  Seed: RLLPLLALL (INS_HUMAN)
RILPLLALL

SEQ ID NO: 36330 - protein, 11 aa, Artificial Sequence
  Description of Artificial Sequence: Synthetic peptide
  Seed: ALWGPDPAAAF (INS_HUMAN)
ALWGPDPAAAR

SEQ ID NO: 36331 - protein, 9 aa, Artificial Sequence
  Description of Artificial Sequence: Synthetic peptide
  Seed: RLLPLLALL (INS_HUMAN)
RSLPLLALF

SEQ ID NO: 36332 - protein, 10 aa, Artificial Sequence
  Description of Artificial Sequence: Synthetic peptide
  Seed: HLVEALYLVC (INS_HUMAN)
HMVEALYLVF

SEQ ID NO: 36333 - protein, 9 aa, Artificial Sequence
  Description of Artificial Sequence: Synthetic peptide
  Seed: AEDLQVGQV (INS_HUMAN)
AVDLQVGQL

SEQ ID NO: 36334 - protein, 10 aa, Artificial Sequence
  Description of Artificial Sequence: Synthetic peptide
  Seed: SHLVEALYLV (INS_HUMAN)
SVLVEALYLM

SEQ ID NO: 36335 - protein, 9 aa, Artificial Sequence
  Description of Artificial Sequence: Synthetic peptide
  Seed: SHLVEALYL (INS_HUMAN)
SRLVEALYL

SEQ ID NO: 36336 - protein, 10 aa, Artificial Sequence
  Description of Artificial Sequence: Synthetic peptide
  Seed: LALWGPDPAA (INS_HUMAN)
LRLWGPDPAV

SEQ ID NO: 36337 - protein, 9 aa, Artificial Sequence
  Description of Artificial Sequence: Synthetic peptide
  Seed: YLVCGERGF (INS_HUMAN)
YVVCGERGY

SEQ ID NO: 36338 - protein, 11 aa, Artificial Sequence
  Description of Artificial Sequence: Synthetic peptide
  Seed: WMRLLPLLALL (INS_HUMAN)
WLRLLPLLALV

SEQ ID NO: 36339 - protein, 9 aa, Artificial Sequence
  Description of Artificial Sequence: Synthetic peptide
  Seed: FVNQHLCGS (INS_HUMAN)
FLNQHLCGT

SEQ ID NO: 36340 - protein, 9 aa, Artificial Sequence
  Description of Artificial Sequence: Synthetic peptide
  Seed: AGSLQPLAL (INS_HUMAN)
ATSLQPLAI

SEQ ID NO: 36341 - protein, 10 aa, Artificial Sequence
  Description of Artificial Sequence: Synthetic peptide
  Seed: MALWMRLLPL (INS_HUMAN)
MCLWMRLLPF

SEQ ID NO: 36342 - protein, 10 aa, Artificial Sequence
  Description of Artificial Sequence: Synthetic peptide
  Seed: MRLLPLLALL (INS_HUMAN)
MCLLPLLALI

SEQ ID NO: 36343 - protein, 10 aa, Artificial Sequence
  Description of Artificial Sequence: Synthetic peptide
  Seed: MALWMRLLPL (INS_HUMAN)
MTLWMRLLPA

SEQ ID NO: 36344 - protein, 10 aa, Artificial Sequence
  Description of Artificial Sequence: Synthetic peptide
  Seed: HLCGSHLVEA (INS_HUMAN)
HVCGSHLVEV

SEQ ID NO: 36345 - protein, 8 aa, Artificial Sequence
  Description of Artificial Sequence: Synthetic peptide
  Seed: GPDPAAAF (INS_HUMAN)
GLDPAAAL

SEQ ID NO: 36346 - protein, 9 aa, Artificial Sequence
  Description of Artificial Sequence: Synthetic peptide
  Seed: AGSLQPLAL (INS_HUMAN)
ATSLQPLAL

SEQ ID NO: 36347 - protein, 9 aa, Artificial Sequence
  Description of Artificial Sequence: Synthetic peptide
  Seed: RLLPLLALL (INS_HUMAN)
RSLPLLALK

SEQ ID NO: 36348 - protein, 10 aa, Artificial Sequence
  Description of Artificial Sequence: Synthetic peptide
  Seed: SHLVEALYLV (INS_HUMAN)
SSLVEALYLM

SEQ ID NO: 36349 - protein, 9 aa, Artificial Sequence
  Description of Artificial Sequence: Synthetic peptide
  Seed: ALYLVCGER (INS_HUMAN)
ASYLVCGEK

SEQ ID NO: 36350 - protein, 9 aa, Artificial Sequence
  Description of Artificial Sequence: Synthetic peptide
  Seed: TSICSLYQL (INS_HUMAN)
TMICSLYQL

SEQ ID NO: 36351 - protein, 11 aa, Artificial Sequence
  Description of Artificial Sequence: Synthetic peptide
  Seed: ALWGPDPAAAF (INS_HUMAN)
ASWGPDPAAAY

SEQ ID NO: 36352 - protein, 9 aa, Artificial Sequence
  Description of Artificial Sequence: Synthetic peptide
  Seed: LALEGSLQK (INS_HUMAN)
LSLEGSLQY

SEQ ID NO: 36353 - protein, 9 aa, Artificial Sequence
  Description of Artificial Sequence: Synthetic peptide
  Seed: YTPKTRREA (INS_HUMAN)
YSPKTRREY

SEQ ID NO: 36354 - protein, 9 aa, Artificial Sequence
  Description of Artificial Sequence: Synthetic peptide
  Seed: GPDPAAAFV (INS_HUMAN)
GADPAAAFF

SEQ ID NO: 36355 - protein, 10 aa, Artificial Sequence
  Description of Artificial Sequence: Synthetic peptide
  Seed: HLVEALYLVC (INS_HUMAN)
HMVEALYLVS

SEQ ID NO: 36356 - protein, 9 aa, Artificial Sequence
  Description of Artificial Sequence: Synthetic peptide
  Seed: ALWMRLLPL (INS_HUMAN)
ALWMRLLPA

SEQ ID NO: 36357 - protein, 10 aa, Artificial Sequence
  Description of Artificial Sequence: Synthetic peptide
  Seed: LLPLLALLAL (INS_HUMAN)
LMPLLALLAF

SEQ ID NO: 36358 - protein, 9 aa, Artificial Sequence
  Description of Artificial Sequence: Synthetic peptide
  Seed: MRLLPLLAL (INS_HUMAN)
MYLLPLLAI

SEQ ID NO: 36359 - protein, 10 aa, Artificial Sequence
  Description of Artificial Sequence: Synthetic peptide
  Seed: MALWMRLLPL (INS_HUMAN)
MWLWMRLLPV

SEQ ID NO: 36360 - protein, 9 aa, Artificial Sequence
  Description of Artificial Sequence: Synthetic peptide
  Seed: TSICSLYQL (INS_HUMAN)
TTICSLYQM

SEQ ID NO: 36361 - protein, 9 aa, Artificial Sequence
  Description of Artificial Sequence: Synthetic peptide
  Seed: GPDPAAAFV (INS_HUMAN)
GVDPAAAFM

SEQ ID NO: 36362 - protein, 9 aa, Artificial Sequence
  Description of Artificial Sequence: Synthetic peptide
  Seed: MRLLPLLAL (INS_HUMAN)
MRLLPLLAA

SEQ ID NO: 36363 - protein, 10 aa, Artificial Sequence
  Description of Artificial Sequence: Synthetic peptide
  Seed: LALWGPDPAA (INS_HUMAN)
LNLWGPDPAV

SEQ ID NO: 36364 - protein, 9 aa, Artificial Sequence
  Description of Artificial Sequence: Synthetic peptide
  Seed: RLLPLLALL (INS_HUMAN)
RLLPLLALR

SEQ ID NO: 36365 - protein, 9 aa, Artificial Sequence
  Description of Artificial Sequence: Synthetic peptide
  Seed: SLYQLENYC (INS_HUMAN)
SMYQLENYV

SEQ ID NO: 36366 - protein, 10 aa, Artificial Sequence
  Description of Artificial Sequence: Synthetic peptide
  Seed: MRLLPLLALL (INS_HUMAN)
MVLLPLLALV

SEQ ID NO: 36367 - protein, 11 aa, Artificial Sequence
  Description of Artificial Sequence: Synthetic peptide
  Seed: WMRLLPLLALL (INS_HUMAN)
WHRLLPLLALV

SEQ ID NO: 36368 - protein, 9 aa, Artificial Sequence
  Description of Artificial Sequence: Synthetic peptide
  Seed: ALWMRLLPL (INS_HUMAN)
AMWMRLLPF

SEQ ID NO: 36369 - protein, 9 aa, Artificial Sequence
  Description of Artificial Sequence: Synthetic peptide
  Seed: CCTSICSLY (INS_HUMAN)
CYTSICSLY

SEQ ID NO: 36370 - protein, 9 aa, Artificial Sequence
  Description of Artificial Sequence: Synthetic peptide
  Seed: AGSLQPLAL (INS_HUMAN)
ASSLQPLAV

SEQ ID NO: 36371 - protein, 9 aa, Artificial Sequence
  Description of Artificial Sequence: Synthetic peptide
  Seed: AAAFVNQHL (INS_HUMAN)
ASAFVNQHV

SEQ ID NO: 36372 - protein, 11 aa, Artificial Sequence
  Description of Artificial Sequence: Synthetic peptide
  Seed: SHLVEALYLVC (INS_HUMAN)
SLLVEALYLVH

SEQ ID NO: 36373 - protein, 9 aa, Artificial Sequence
  Description of Artificial Sequence: Synthetic peptide
  Seed: WGPDPAAAF (INS_HUMAN)
WVPDPAAAM

SEQ ID NO: 36374 - protein, 10 aa, Artificial Sequence
  Description of Artificial Sequence: Synthetic peptide
  Seed: VNQHLCGSHL (INS_HUMAN)
VMQHLCGSHF

SEQ ID NO: 36375 - protein, 10 aa, Artificial Sequence
  Description of Artificial Sequence: Synthetic peptide
  Seed: LLPLLALLAL (INS_HUMAN)
LRPLLALLAL

SEQ ID NO: 36376 - protein, 9 aa, Artificial Sequence
  Description of Artificial Sequence: Synthetic peptide
  Seed: AAAFVNQHL (INS_HUMAN)
ASAFVNQHM

SEQ ID NO: 36377 - protein, 9 aa, Artificial Sequence
  Description of Artificial Sequence: Synthetic peptide
  Seed: HLVEALYLV (INS_HUMAN)
HQVEALYLM

SEQ ID NO: 36378 - protein, 9 aa, Artificial Sequence
  Description of Artificial Sequence: Synthetic peptide
  Seed: ALWMRLLPL (INS_HUMAN)
AVWMRLLPM

SEQ ID NO: 36379 - protein, 10 aa, Artificial Sequence
  Description of Artificial Sequence: Synthetic peptide
  Seed: MRLLPLLALL (INS_HUMAN)
MRLLPLLALI

SEQ ID NO: 36380 - protein, 9 aa, Artificial Sequence
  Description of Artificial Sequence: Synthetic peptide
  Seed: GGGPGAGSL (INS_HUMAN)
GAGPGAGSL

SEQ ID NO: 36381 - protein, 9 aa, Artificial Sequence
  Description of Artificial Sequence: Synthetic peptide
  Seed: ALWGPDPAA (INS_HUMAN)
AMWGPDPAV

SEQ ID NO: 36382 - protein, 10 aa, Artificial Sequence
  Description of Artificial Sequence: Synthetic peptide
  Seed: SHLVEALYLV (INS_HUMAN)
SLLVEALYLL

SEQ ID NO: 36383 - protein, 11 aa, Artificial Sequence
  Description of Artificial Sequence: Synthetic peptide
  Seed: MRLLPLLALLA (INS_HUMAN)
MRLLPLLALLK

SEQ ID NO: 36384 - protein, 10 aa, Artificial Sequence
  Description of Artificial Sequence: Synthetic peptide
  Seed: RLLPLLALLA (INS_HUMAN)
RMLPLLALLA

SEQ ID NO: 36385 - protein, 9 aa, Artificial Sequence
  Description of Artificial Sequence: Synthetic peptide
  Seed: SLYQLENYC (INS_HUMAN)
SMYQLENYA

SEQ ID NO: 36386 - protein, 11 aa, Artificial Sequence
  Description of Artificial Sequence: Synthetic peptide
  Seed: GSHLVEALYLV (INS_HUMAN)
GQHLVEALYLV

SEQ ID NO: 36387 - protein, 10 aa, Artificial Sequence
  Description of Artificial Sequence: Synthetic peptide
  Seed: SHLVEALYLV (INS_HUMAN)
SWLVEALYLI

SEQ ID NO: 36388 - protein, 8 aa, Artificial Sequence
  Description of Artificial Sequence: Synthetic peptide
  Seed: LWMRLLPL (INS_HUMAN)
LLMRLLPL

SEQ ID NO: 36389 - protein, 10 aa, Artificial Sequence
  Description of Artificial Sequence: Synthetic peptide
  Seed: VNQHLCGSHL (INS_HUMAN)
VEQHLCGSHF

SEQ ID NO: 36390 - protein, 10 aa, Artificial Sequence
  Description of Artificial Sequence: Synthetic peptide
  Seed: SHLVEALYLV (INS_HUMAN)
SDLVEALYLM

SEQ ID NO: 36391 - protein, 10 aa, Artificial Sequence
  Description of Artificial Sequence: Synthetic peptide
  Seed: MALWMRLLPL (INS_HUMAN)
MQLWMRLLPI

SEQ ID NO: 36392 - protein, 9 aa, Artificial Sequence
  Description of Artificial Sequence: Synthetic peptide
  Seed: WGPDPAAAF (INS_HUMAN)
WVPDPAAAY

SEQ ID NO: 36393 - protein, 9 aa, Artificial Sequence
  Description of Artificial Sequence: Synthetic peptide
  Seed: LWMRLLPLL (INS_HUMAN)
LYMRLLPLM

SEQ ID NO: 36394 - protein, 9 aa, Artificial Sequence
  Description of Artificial Sequence: Synthetic peptide
  Seed: AAFVNQHLC (INS_HUMAN)
AMFVNQHLW

SEQ ID NO: 36395 - protein, 10 aa, Artificial Sequence
  Description of Artificial Sequence: Synthetic peptide
  Seed: SHLVEALYLV (INS_HUMAN)
SCLVEALYLI

SEQ ID NO: 36396 - protein, 11 aa, Artificial Sequence
  Description of Artificial Sequence: Synthetic peptide
  Seed: ALWGPDPAAAF (INS_HUMAN)
AVWGPDPAAAF

SEQ ID NO: 36397 - protein, 9 aa, Artificial Sequence
  Description of Artificial Sequence: Synthetic peptide
  Seed: FVNQHLCGS (INS_HUMAN)
FTNQHLCGV

SEQ ID NO: 36398 - protein, 9 aa, Artificial Sequence
  Description of Artificial Sequence: Synthetic peptide
  Seed: ALWMRLLPL (INS_HUMAN)
ALWMRLLPW

SEQ ID NO: 36399 - protein, 11 aa, Artificial Sequence
  Description of Artificial Sequence: Synthetic peptide
  Seed: ELGGGPGAGSL (INS_HUMAN)
ELGGGPGAGSY

SEQ ID NO: 36400 - protein, 9 aa, Artificial Sequence
  Description of Artificial Sequence: Synthetic peptide
  Seed: LALWGPDPA (INS_HUMAN)
LLLWGPDPI

SEQ ID NO: 36401 - protein, 9 aa, Artificial Sequence
  Description of Artificial Sequence: Synthetic peptide
  Seed: RLLPLLALL (INS_HUMAN)
RMLPLLALI

SEQ ID NO: 36402 - protein, 9 aa, Artificial Sequence
  Description of Artificial Sequence: Synthetic peptide
  Seed: MRLLPLLAL (INS_HUMAN)
MQLLPLLAY

SEQ ID NO: 36403 - protein, 9 aa, Artificial Sequence
  Description of Artificial Sequence: Synthetic peptide
  Seed: MRLLPLLAL (INS_HUMAN)
MNLLPLLAF

SEQ ID NO: 36404 - protein, 10 aa, Artificial Sequence
  Description of Artificial Sequence: Synthetic peptide
  Seed: ALWMRLLPLL (INS_HUMAN)
AYWMRLLPLF

SEQ ID NO: 36405 - protein, 10 aa, Artificial Sequence
  Description of Artificial Sequence: Synthetic peptide
  Seed: SHLVEALYLV (INS_HUMAN)
STLVEALYLV

SEQ ID NO: 36406 - protein, 11 aa, Artificial Sequence
  Description of Artificial Sequence: Synthetic peptide
  Seed: ALWGPDPAAAF (INS_HUMAN)
AYWGPDPAAAL

SEQ ID NO: 36407 - protein, 10 aa, Artificial Sequence
  Description of Artificial Sequence: Synthetic peptide
  Seed: ICSLYQLENY (INS_HUMAN)
ITSLYQLENY

SEQ ID NO: 36408 - protein, 11 aa, Artificial Sequence
  Description of Artificial Sequence: Synthetic peptide
  Seed: GSHLVEALYLV (INS_HUMAN)
GRHLVEALYLV

SEQ ID NO: 36409 - protein, 9 aa, Artificial Sequence
  Description of Artificial Sequence: Synthetic peptide
  Seed: ALWMRLLPL (INS_HUMAN)
ATWMRLLPF

SEQ ID NO: 36410 - protein, 11 aa, Artificial Sequence
  Description of Artificial Sequence: Synthetic peptide
  Seed: RGFFYTPKTRR (INS_HUMAN)
RFFFYTPKTRR

SEQ ID NO: 36411 - protein, 11 aa, Artificial Sequence
  Description of Artificial Sequence: Synthetic peptide
  Seed: RGFFYTPKTRR (INS_HUMAN)
RLFFYTPKTRR

SEQ ID NO: 36412 - protein, 10 aa, Artificial Sequence
  Description of Artificial Sequence: Synthetic peptide
  Seed: MRLLPLLALL (INS_HUMAN)
MPLLPLLALA

SEQ ID NO: 36413 - protein, 8 aa, Artificial Sequence
  Description of Artificial Sequence: Synthetic peptide
  Seed: LVEALYLV (INS_HUMAN)
LMEALYLA

SEQ ID NO: 36414 - protein, 9 aa, Artificial Sequence
  Description of Artificial Sequence: Synthetic peptide
  Seed: HLVEALYLV (INS_HUMAN)
HLVEALYLL

SEQ ID NO: 36415 - protein, 9 aa, Artificial Sequence
  Description of Artificial Sequence: Synthetic peptide
  Seed: AAAFVNQHL (INS_HUMAN)
ARAFVNQHL

SEQ ID NO: 36416 - protein, 10 aa, Artificial Sequence
  Description of Artificial Sequence: Synthetic peptide
  Seed: WMRLLPLLAL (INS_HUMAN)
WTRLLPLLAM

SEQ ID NO: 36417 - protein, 10 aa, Artificial Sequence
  Description of Artificial Sequence: Synthetic peptide
  Seed: MALWMRLLPL (INS_HUMAN)
MTLWMRLLPI

SEQ ID NO: 36418 - protein, 10 aa, Artificial Sequence
  Description of Artificial Sequence: Synthetic peptide
  Seed: WMRLLPLLAL (INS_HUMAN)
WWRLLPLLAI

SEQ ID NO: 36419 - protein, 10 aa, Artificial Sequence
  Description of Artificial Sequence: Synthetic peptide
  Seed: YLVCGERGFF (INS_HUMAN)
YMVCGERGFF

SEQ ID NO: 36420 - protein, 9 aa, Artificial Sequence
  Description of Artificial Sequence: Synthetic peptide
  Seed: CSLYQLENY (INS_HUMAN)
CSLYQLENF

SEQ ID NO: 36421 - protein, 9 aa, Artificial Sequence
  Description of Artificial Sequence: Synthetic peptide
  Seed: HLVEALYLV (INS_HUMAN)
HVVEALYLK

SEQ ID NO: 36422 - protein, 10 aa, Artificial Sequence
  Description of Artificial Sequence: Synthetic peptide
  Seed: SHLVEALYLV (INS_HUMAN)
SYLVEALYLI

SEQ ID NO: 36423 - protein, 11 aa, Artificial Sequence
  Description of Artificial Sequence: Synthetic peptide
  Seed: SHLVEALYLVC (INS_HUMAN)
SFLVEALYLVL

SEQ ID NO: 36424 - protein, 9 aa, Artificial Sequence
  Description of Artificial Sequence: Synthetic peptide
  Seed: WGPDPAAAF (INS_HUMAN)
WPPDPAAAF

SEQ ID NO: 36425 - protein, 10 aa, Artificial Sequence
  Description of Artificial Sequence: Synthetic peptide
  Seed: WMRLLPLLAL (INS_HUMAN)
WPRLLPLLAA

SEQ ID NO: 36426 - protein, 9 aa, Artificial Sequence
  Description of Artificial Sequence: Synthetic peptide
  Seed: WGPDPAAAF (INS_HUMAN)
WCPDPAAAL

SEQ ID NO: 36427 - protein, 9 aa, Artificial Sequence
  Description of Artificial Sequence: Synthetic peptide
  Seed: AGSLQPLAL (INS_HUMAN)
AYSLQPLAF

SEQ ID NO: 36428 - protein, 9 aa, Artificial Sequence
  Description of Artificial Sequence: Synthetic peptide
  Seed: QPLALEGSL (INS_HUMAN)
QPLALEGSY

SEQ ID NO: 36429 - protein, 9 aa, Artificial Sequence
  Description of Artificial Sequence: Synthetic peptide
  Seed: WGPDPAAAF (INS_HUMAN)
WQPDPAAAF

SEQ ID NO: 36430 - protein, 9 aa, Artificial Sequence
  Description of Artificial Sequence: Synthetic peptide
  Seed: SLYQLENYC (INS_HUMAN)
SIYQLENYL

SEQ ID NO: 36431 - protein, 9 aa, Artificial Sequence
  Description of Artificial Sequence: Synthetic peptide
  Seed: MRLLPLLAL (INS_HUMAN)
MQLLPLLAI

SEQ ID NO: 36432 - protein, 9 aa, Artificial Sequence
  Description of Artificial Sequence: Synthetic peptide
  Seed: GPDPAAAFV (INS_HUMAN)
GSDPAAAFV

SEQ ID NO: 36433 - protein, 11 aa, Artificial Sequence
  Description of Artificial Sequence: Synthetic peptide
  Seed: GSHLVEALYLV (INS_HUMAN)
GMHLVEALYLL

SEQ ID NO: 36434 - protein, 10 aa, Artificial Sequence
  Description of Artificial Sequence: Synthetic peptide
  Seed: VNQHLCGSHL (INS_HUMAN)
VAQHLCGSHY

SEQ ID NO: 36435 - protein, 9 aa, Artificial Sequence
  Description of Artificial Sequence: Synthetic peptide
  Seed: AEDLQVGQV (INS_HUMAN)
ATDLQVGQL

SEQ ID NO: 36436 - protein, 10 aa, Artificial Sequence
  Description of Artificial Sequence: Synthetic peptide
  Seed: REAEDLQVGQ (INS_HUMAN)
REAEDLQVGV

SEQ ID NO: 36437 - protein, 10 aa, Artificial Sequence
  Description of Artificial Sequence: Synthetic peptide
  Seed: SHLVEALYLV (INS_HUMAN)
SYLVEALYLV

SEQ ID NO: 36438 - protein, 9 aa, Artificial Sequence
  Description of Artificial Sequence: Synthetic peptide
  Seed: AEDLQVGQV (INS_HUMAN)
ATDLQVGQI

SEQ ID NO: 36439 - protein, 9 aa, Artificial Sequence
  Description of Artificial Sequence: Synthetic peptide
  Seed: ALWMRLLPL (INS_HUMAN)
ATWMRLLPY

SEQ ID NO: 36440 - protein, 9 aa, Artificial Sequence
  Description of Artificial Sequence: Synthetic peptide
  Seed: MRLLPLLAL (INS_HUMAN)
MSLLPLLAF

SEQ ID NO: 36441 - protein, 9 aa, Artificial Sequence
  Description of Artificial Sequence: Synthetic peptide
  Seed: FVNQHLCGS (INS_HUMAN)
FMNQHLCGC

SEQ ID NO: 36442 - protein, 10 aa, Artificial Sequence
  Description of Artificial Sequence: Synthetic peptide
  Seed: LLPLLALLAL (INS_HUMAN)
LAPLLALLAY

SEQ ID NO: 36443 - protein, 10 aa, Artificial Sequence
  Description of Artificial Sequence: Synthetic peptide
  Seed: MALWMRLLPL (INS_HUMAN)
MYLWMRLLPF

SEQ ID NO: 36444 - protein, 10 aa, Artificial Sequence
  Description of Artificial Sequence: Synthetic peptide
  Seed: RGFFYTPKTR (INS_HUMAN)
RAFFYTPKTR

SEQ ID NO: 36445 - protein, 9 aa, Artificial Sequence
  Description of Artificial Sequence: Synthetic peptide
  Seed: WMRLLPLLA (INS_HUMAN)
WTRLLPLLK

SEQ ID NO: 36446 - protein, 9 aa, Artificial Sequence
  Description of Artificial Sequence: Synthetic peptide
  Seed: WGPDPAAAF (INS_HUMAN)
WFPDPAAAY

SEQ ID NO: 36447 - protein, 11 aa, Artificial Sequence
  Description of Artificial Sequence: Synthetic peptide
  Seed: ALWGPDPAAAF (INS_HUMAN)
AKWGPDPAAAF

SEQ ID NO: 36448 - protein, 10 aa, Artificial Sequence
  Description of Artificial Sequence: Synthetic peptide
  Seed: ALWMRLLPLL (INS_HUMAN)
AIWMRLLPLV

SEQ ID NO: 36449 - protein, 9 aa, Artificial Sequence
  Description of Artificial Sequence: Synthetic peptide
  Seed: VCGERGFFY (INS_HUMAN)
VAGERGFFM

SEQ ID NO: 36450 - protein, 10 aa, Artificial Sequence
  Description of Artificial Sequence: Synthetic peptide
  Seed: ALWMRLLPLL (INS_HUMAN)
ASWMRLLPLF

SEQ ID NO: 36451 - protein, 9 aa, Artificial Sequence
  Description of Artificial Sequence: Synthetic peptide
  Seed: MRLLPLLAL (INS_HUMAN)
MMLLPLLAM

SEQ ID NO: 36452 - protein, 11 aa, Artificial Sequence
  Description of Artificial Sequence: Synthetic peptide
  Seed: ALWGPDPAAAF (INS_HUMAN)
AVWGPDPAAAL

SEQ ID NO: 36453 - protein, 10 aa, Artificial Sequence
  Description of Artificial Sequence: Synthetic peptide
  Seed: MALWMRLLPL (INS_HUMAN)
MELWMRLLPM

SEQ ID NO: 36454 - protein, 9 aa, Artificial Sequence
  Description of Artificial Sequence: Synthetic peptide
  Seed: AGSLQPLAL (INS_HUMAN)
AISLQPLAF

SEQ ID NO: 36455 - protein, 11 aa, Artificial Sequence
  Description of Artificial Sequence: Synthetic peptide
  Seed: SHLVEALYLVC (INS_HUMAN)
SLLVEALYLVS

SEQ ID NO: 36456 - protein, 9 aa, Artificial Sequence
  Description of Artificial Sequence: Synthetic peptide
  Seed: SLYQLENYC (INS_HUMAN)
SIYQLENYI

SEQ ID NO: 36457 - protein, 11 aa, Artificial Sequence
  Description of Artificial Sequence: Synthetic peptide
  Seed: AEDLQVGQVEL (INS_HUMAN)
AQDLQVGQVEF

SEQ ID NO: 36458 - protein, 9 aa, Artificial Sequence
  Description of Artificial Sequence: Synthetic peptide
  Seed: SLYQLENYC (INS_HUMAN)
SMYQLENYL

SEQ ID NO: 36459 - protein, 9 aa, Artificial Sequence
  Description of Artificial Sequence: Synthetic peptide
  Seed: AAAFVNQHL (INS_HUMAN)
AQAFVNQHV

SEQ ID NO: 36460 - protein, 9 aa, Artificial Sequence
  Description of Artificial Sequence: Synthetic peptide
  Seed: NQHLCGSHL (INS_HUMAN)
NHHLCGSHF

SEQ ID NO: 36461 - protein, 9 aa, Artificial Sequence
  Description of Artificial Sequence: Synthetic peptide
  Seed: AAAFVNQHL (INS_HUMAN)
ASAFVNQHF

SEQ ID NO: 36462 - protein, 9 aa, Artificial Sequence
  Description of Artificial Sequence: Synthetic peptide
  Seed: CGSHLVEAL (INS_HUMAN)
CASHLVEAY

SEQ ID NO: 36463 - protein, 11 aa, Artificial Sequence
  Description of Artificial Sequence: Synthetic peptide
  Seed: WMRLLPLLALL (INS_HUMAN)
WSRLLPLLALL

SEQ ID NO: 36464 - protein, 11 aa, Artificial Sequence
  Description of Artificial Sequence: Synthetic peptide
  Seed: SHLVEALYLVC (INS_HUMAN)
SMLVEALYLVF

SEQ ID NO: 36465 - protein, 11 aa, Artificial Sequence
  Description of Artificial Sequence: Synthetic peptide
  Seed: MRLLPLLALLA (INS_HUMAN)
MYLLPLLALLV

SEQ ID NO: 36466 - protein, 10 aa, Artificial Sequence
  Description of Artificial Sequence: Synthetic peptide
  Seed: LLPLLALLAL (INS_HUMAN)
LRPLLALLAY

SEQ ID NO: 36467 - protein, 9 aa, Artificial Sequence
  Description of Artificial Sequence: Synthetic peptide
  Seed: LPLLALLAL (INS_HUMAN)
LALLALLAM

SEQ ID NO: 36468 - protein, 9 aa, Artificial Sequence
  Description of Artificial Sequence: Synthetic peptide
  Seed: RLLPLLALL (INS_HUMAN)
RLLPLLALA

SEQ ID NO: 36469 - protein, 9 aa, Artificial Sequence
  Description of Artificial Sequence: Synthetic peptide
  Seed: WGPDPAAAF (INS_HUMAN)
WIPDPAAAV

SEQ ID NO: 36470 - protein, 9 aa, Artificial Sequence
  Description of Artificial Sequence: Synthetic peptide
  Seed: MRLLPLLAL (INS_HUMAN)
MSLLPLLAM

SEQ ID NO: 36471 - protein, 9 aa, Artificial Sequence
  Description of Artificial Sequence: Synthetic peptide
  Seed: HLVEALYLV (INS_HUMAN)
HQVEALYLI

SEQ ID NO: 36472 - protein, 10 aa, Artificial Sequence
  Description of Artificial Sequence: Synthetic peptide
  Seed: MALWMRLLPL (INS_HUMAN)
MDLWMRLLPL

SEQ ID NO: 36473 - protein, 11 aa, Artificial Sequence
  Description of Artificial Sequence: Synthetic peptide
  Seed: WMRLLPLLALL (INS_HUMAN)
WMRLLPLLALV

SEQ ID NO: 36474 - protein, 9 aa, Artificial Sequence
  Description of Artificial Sequence: Synthetic peptide
  Seed: HLVEALYLV (INS_HUMAN)
HIVEALYLR

SEQ ID NO: 36475 - protein, 9 aa, Artificial Sequence
  Description of Artificial Sequence: Synthetic peptide
  Seed: RLLPLLALL (INS_HUMAN)
RILPLLALA

SEQ ID NO: 36476 - protein, 10 aa, Artificial Sequence
  Description of Artificial Sequence: Synthetic peptide
  Seed: MALWMRLLPL (INS_HUMAN)
MGLWMRLLPV

SEQ ID NO: 36477 - protein, 9 aa, Artificial Sequence
  Description of Artificial Sequence: Synthetic peptide
  Seed: GGGPGAGSL (INS_HUMAN)
GAGPGAGSM

SEQ ID NO: 36478 - protein, 10 aa, Artificial Sequence
  Description of Artificial Sequence: Synthetic peptide
  Seed: MRLLPLLALL (INS_HUMAN)
MELLPLLALI

SEQ ID NO: 36479 - protein, 8 aa, Artificial Sequence
  Description of Artificial Sequence: Synthetic peptide
  Seed: LVEALYLV (INS_HUMAN)
LMEALYLV

SEQ ID NO: 36480 - protein, 9 aa, Artificial Sequence
  Description of Artificial Sequence: Synthetic peptide
  Seed: VELGGGPGA (INS_HUMAN)
VELGGGPGP

SEQ ID NO: 36481 - protein, 9 aa, Artificial Sequence
  Description of Artificial Sequence: Synthetic peptide
  Seed: MALWMRLLP (INS_HUMAN)
MPLWMRLLC

SEQ ID NO: 36482 - protein, 9 aa, Artificial Sequence
  Description of Artificial Sequence: Synthetic peptide
  Seed: GPDPAAAFV (INS_HUMAN)
GGDPAAAFI

SEQ ID NO: 36483 - protein, 8 aa, Artificial Sequence
  Description of Artificial Sequence: Synthetic peptide
  Seed: LWMRLLPL (INS_HUMAN)
LPMRLLPM

SEQ ID NO: 36484 - protein, 9 aa, Artificial Sequence
  Description of Artificial Sequence: Synthetic peptide
  Seed: AGSLQPLAL (INS_HUMAN)
AYSLQPLAM

SEQ ID NO: 36485 - protein, 10 aa, Artificial Sequence
  Description of Artificial Sequence: Synthetic peptide
  Seed: HLCGSHLVEA (INS_HUMAN)
HICGSHLVEV

SEQ ID NO: 36486 - protein, 9 aa, Artificial Sequence
  Description of Artificial Sequence: Synthetic peptide
  Seed: LWMRLLPLL (INS_HUMAN)
LFMRLLPLL

SEQ ID NO: 36487 - protein, 9 aa, Artificial Sequence
  Description of Artificial Sequence: Synthetic peptide
  Seed: GFFYTPKTR (INS_HUMAN)
GTFYTPKTR

SEQ ID NO: 36488 - protein, 10 aa, Artificial Sequence
  Description of Artificial Sequence: Synthetic peptide
  Seed: RGFFYTPKTR (INS_HUMAN)
RTFFYTPKTA

SEQ ID NO: 36489 - protein, 11 aa, Artificial Sequence
  Description of Artificial Sequence: Synthetic peptide
  Seed: GSHLVEALYLV (INS_HUMAN)
GKHLVEALYLI

SEQ ID NO: 36490 - protein, 9 aa, Artificial Sequence
  Description of Artificial Sequence: Synthetic peptide
  Seed: GFFYTPKTR (INS_HUMAN)
GSFYTPKTR

SEQ ID NO: 36491 - protein, 10 aa, Artificial Sequence
  Description of Artificial Sequence: Synthetic peptide
  Seed: RLLPLLALLA (INS_HUMAN)
RLLPLLALLT

SEQ ID NO: 36492 - protein, 9 aa, Artificial Sequence
  Description of Artificial Sequence: Synthetic peptide
  Seed: ALWMRLLPL (INS_HUMAN)
AQWMRLLPI

SEQ ID NO: 36493 - protein, 9 aa, Artificial Sequence
  Description of Artificial Sequence: Synthetic peptide
  Seed: NQHLCGSHL (INS_HUMAN)
NAHLCGSHY

SEQ ID NO: 36494 - protein, 9 aa, Artificial Sequence
  Description of Artificial Sequence: Synthetic peptide
  Seed: RLLPLLALL (INS_HUMAN)
RILPLLALY

SEQ ID NO: 36495 - protein, 10 aa, Artificial Sequence
  Description of Artificial Sequence: Synthetic peptide
  Seed: SHLVEALYLV (INS_HUMAN)
SNLVEALYLI

SEQ ID NO: 36496 - protein, 9 aa, Artificial Sequence
  Description of Artificial Sequence: Synthetic peptide
  Seed: RLLPLLALL (INS_HUMAN)
RMLPLLALC

SEQ ID NO: 36497 - protein, 9 aa, Artificial Sequence
  Description of Artificial Sequence: Synthetic peptide
  Seed: AAAFVNQHL (INS_HUMAN)
AMAFVNQHV

SEQ ID NO: 36498 - protein, 9 aa, Artificial Sequence
  Description of Artificial Sequence: Synthetic peptide
  Seed: LPLLALLAL (INS_HUMAN)
LPLLALLAT

SEQ ID NO: 36499 - protein, 10 aa, Artificial Sequence
  Description of Artificial Sequence: Synthetic peptide
  Seed: LVCGERGFFY (INS_HUMAN)
LSCGERGFFF

SEQ ID NO: 36500 - protein, 9 aa, Artificial Sequence
  Description of Artificial Sequence: Synthetic peptide
  Seed: WGPDPAAAF (INS_HUMAN)
WWPDPAAAM

SEQ ID NO: 36501 - protein, 10 aa, Artificial Sequence
  Description of Artificial Sequence: Synthetic peptide
  Seed: EALYLVCGER (INS_HUMAN)
EVLYLVCGEK

SEQ ID NO: 36502 - protein, 10 aa, Artificial Sequence
  Description of Artificial Sequence: Synthetic peptide
  Seed: VNQHLCGSHL (INS_HUMAN)
VPQHLCGSHY

SEQ ID NO: 36503 - protein, 9 aa, Artificial Sequence
  Description of Artificial Sequence: Synthetic peptide
  Seed: RLLPLLALL (INS_HUMAN)
RQLPLLALR

SEQ ID NO: 36504 - protein, 11 aa, Artificial Sequence
  Description of Artificial Sequence: Synthetic peptide
  Seed: GSHLVEALYLV (INS_HUMAN)
GWHLVEALYLL

SEQ ID NO: 36505 - protein, 10 aa, Artificial Sequence
  Description of Artificial Sequence: Synthetic peptide
  Seed: RLLPLLALLA (INS_HUMAN)
RLLPLLALLS

SEQ ID NO: 36506 - protein, 8 aa, Artificial Sequence
  Description of Artificial Sequence: Synthetic peptide
  Seed: GSHLVEAL (INS_HUMAN)
GQHLVEAV

SEQ ID NO: 36507 - protein, 10 aa, Artificial Sequence
  Description of Artificial Sequence: Synthetic peptide
  Seed: ICSLYQLENY (INS_HUMAN)
ITSLYQLENF

SEQ ID NO: 36508 - protein, 9 aa, Artificial Sequence
  Description of Artificial Sequence: Synthetic peptide
  Seed: AAFVNQHLC (INS_HUMAN)
ALFVNQHLW

SEQ ID NO: 36509 - protein, 11 aa, Artificial Sequence
  Description of Artificial Sequence: Synthetic peptide
  Seed: VELGGGPGAGS (INS_HUMAN)
VELGGGPGAGI

SEQ ID NO: 36510 - protein, 9 aa, Artificial Sequence
  Description of Artificial Sequence: Synthetic peptide
  Seed: AAFVNQHLC (INS_HUMAN)
ATFVNQHLW

SEQ ID NO: 36511 - protein, 11 aa, Artificial Sequence
  Description of Artificial Sequence: Synthetic peptide
  Seed: REAEDLQVGQV (INS_HUMAN)
RQAEDLQVGQM

SEQ ID NO: 36512 - protein, 9 aa, Artificial Sequence
  Description of Artificial Sequence: Synthetic peptide
  Seed: LALWGPDPA (INS_HUMAN)
LMLWGPDPA

SEQ ID NO: 36513 - protein, 9 aa, Artificial Sequence
  Description of Artificial Sequence: Synthetic peptide
  Seed: YLVCGERGF (INS_HUMAN)
YQVCGERGF

SEQ ID NO: 36514 - protein, 11 aa, Artificial Sequence
  Description of Artificial Sequence: Synthetic peptide
  Seed: MRLLPLLALLA (INS_HUMAN)
MFLLPLLALLV

SEQ ID NO: 36515 - protein, 11 aa, Artificial Sequence
  Description of Artificial Sequence: Synthetic peptide
  Seed: ALWGPDPAAAF (INS_HUMAN)
AIWGPDPAAAW

SEQ ID NO: 36516 - protein, 10 aa, Artificial Sequence
  Description of Artificial Sequence: Synthetic peptide
  Seed: ALWGPDPAAA (INS_HUMAN)
AIWGPDPAAL

SEQ ID NO: 36517 - protein, 11 aa, Artificial Sequence
  Description of Artificial Sequence: Synthetic peptide
  Seed: ELGGGPGAGSL (INS_HUMAN)
EMGGGPGAGSY

SEQ ID NO: 36518 - protein, 11 aa, Artificial Sequence
  Description of Artificial Sequence: Synthetic peptide
  Seed: REAEDLQVGQV (INS_HUMAN)
REAEDLQVGQY

SEQ ID NO: 36519 - protein, 10 aa, Artificial Sequence
  Description of Artificial Sequence: Synthetic peptide
  Seed: EDLQVGQVEL (INS_HUMAN)
EELQVGQVEA

SEQ ID NO: 36520 - protein, 11 aa, Artificial Sequence
  Description of Artificial Sequence: Synthetic peptide
  Seed: GGPGAGSLQPL (INS_HUMAN)
GAPGAGSLQPY

SEQ ID NO: 36521 - protein, 10 aa, Artificial Sequence
  Description of Artificial Sequence: Synthetic peptide
  Seed: SHLVEALYLV (INS_HUMAN)
SNLVEALYLM

SEQ ID NO: 36522 - protein, 9 aa, Artificial Sequence
  Description of Artificial Sequence: Synthetic peptide
  Seed: TSICSLYQL (INS_HUMAN)
TTICSLYQW

SEQ ID NO: 36523 - protein, 10 aa, Artificial Sequence
  Description of Artificial Sequence: Synthetic peptide
  Seed: LPLLALLALW (INS_HUMAN)
LTLLALLALW

SEQ ID NO: 36524 - protein, 9 aa, Artificial Sequence
  Description of Artificial Sequence: Synthetic peptide
  Seed: HLVEALYLV (INS_HUMAN)
HIVEALYLL

SEQ ID NO: 36525 - protein, 10 aa, Artificial Sequence
  Description of Artificial Sequence: Synthetic peptide
  Seed: MRLLPLLALL (INS_HUMAN)
MYLLPLLALM

SEQ ID NO: 36526 - protein, 11 aa, Artificial Sequence
  Description of Artificial Sequence: Synthetic peptide
  Seed: ALWGPDPAAAF (INS_HUMAN)
ATWGPDPAAAK

SEQ ID NO: 36527 - protein, 9 aa, Artificial Sequence
  Description of Artificial Sequence: Synthetic peptide
  Seed: RLLPLLALL (INS_HUMAN)
RLLPLLALC

SEQ ID NO: 36528 - protein, 10 aa, Artificial Sequence
  Description of Artificial Sequence: Synthetic peptide
  Seed: MALWMRLLPL (INS_HUMAN)
MMLWMRLLPA

SEQ ID NO: 36529 - protein, 9 aa, Artificial Sequence
  Description of Artificial Sequence: Synthetic peptide
  Seed: LALWGPDPA (INS_HUMAN)
LMLWGPDPV

SEQ ID NO: 36530 - protein, 11 aa, Artificial Sequence
  Description of Artificial Sequence: Synthetic peptide
  Seed: SHLVEALYLVC (INS_HUMAN)
SLLVEALYLVV

SEQ ID NO: 36531 - protein, 9 aa, Artificial Sequence
  Description of Artificial Sequence: Synthetic peptide
  Seed: AAFVNQHLC (INS_HUMAN)
AVFVNQHLW

SEQ ID NO: 36532 - protein, 10 aa, Artificial Sequence
  Description of Artificial Sequence: Synthetic peptide
  Seed: WMRLLPLLAL (INS_HUMAN)
WWRLLPLLAM

SEQ ID NO: 36533 - protein, 9 aa, Artificial Sequence
  Description of Artificial Sequence: Synthetic peptide
  Seed: ALWMRLLPL (INS_HUMAN)
AQWMRLLPL

SEQ ID NO: 36534 - protein, 9 aa, Artificial Sequence
  Description of Artificial Sequence: Synthetic peptide
  Seed: TSICSLYQL (INS_HUMAN)
TIICSLYQI

SEQ ID NO: 36535 - protein, 10 aa, Artificial Sequence
  Description of Artificial Sequence: Synthetic peptide
  Seed: ALWMRLLPLL (INS_HUMAN)
AIWMRLLPLI

SEQ ID NO: 36536 - protein, 10 aa, Artificial Sequence
  Description of Artificial Sequence: Synthetic peptide
  Seed: WMRLLPLLAL (INS_HUMAN)
WRRLLPLLAF

SEQ ID NO: 36537 - protein, 10 aa, Artificial Sequence
  Description of Artificial Sequence: Synthetic peptide
  Seed: MRLLPLLALL (INS_HUMAN)
MRLLPLLALF

SEQ ID NO: 36538 - protein, 11 aa, Artificial Sequence
  Description of Artificial Sequence: Synthetic peptide
  Seed: ALWGPDPAAAF (INS_HUMAN)
AVWGPDPAAAK

SEQ ID NO: 36539 - protein, 9 aa, Artificial Sequence
  Description of Artificial Sequence: Synthetic peptide
  Seed: FVNQHLCGS (INS_HUMAN)
FSNQHLCGL

SEQ ID NO: 36540 - protein, 9 aa, Artificial Sequence
  Description of Artificial Sequence: Synthetic peptide
  Seed: TSICSLYQL (INS_HUMAN)
TQICSLYQA

SEQ ID NO: 36541 - protein, 11 aa, Artificial Sequence
  Description of Artificial Sequence: Synthetic peptide
  Seed: WMRLLPLLALL (INS_HUMAN)
WKRLLPLLALV

SEQ ID NO: 36542 - protein, 10 aa, Artificial Sequence
  Description of Artificial Sequence: Synthetic peptide
  Seed: WMRLLPLLAL (INS_HUMAN)
WDRLLPLLAM

SEQ ID NO: 36543 - protein, 10 aa, Artificial Sequence
  Description of Artificial Sequence: Synthetic peptide
  Seed: RLLPLLALLA (INS_HUMAN)
RLLPLLALLM

SEQ ID NO: 36544 - protein, 10 aa, Artificial Sequence
  Description of Artificial Sequence: Synthetic peptide
  Seed: RLLPLLALLA (INS_HUMAN)
RQLPLLALLL

SEQ ID NO: 36545 - protein, 10 aa, Artificial Sequence
  Description of Artificial Sequence: Synthetic peptide
  Seed: ALWGPDPAAA (INS_HUMAN)
AVWGPDPAAI

SEQ ID NO: 36546 - protein, 10 aa, Artificial Sequence
  Description of Artificial Sequence: Synthetic peptide
  Seed: MALWMRLLPL (INS_HUMAN)
MNLWMRLLPM

SEQ ID NO: 36547 - protein, 10 aa, Artificial Sequence
  Description of Artificial Sequence: Synthetic peptide
  Seed: MALWMRLLPL (INS_HUMAN)
MRLWMRLLPF

SEQ ID NO: 36548 - protein, 9 aa, Artificial Sequence
  Description of Artificial Sequence: Synthetic peptide
  Seed: GSHLVEALY (INS_HUMAN)
GTHLVEALF

SEQ ID NO: 36549 - protein, 9 aa, Artificial Sequence
  Description of Artificial Sequence: Synthetic peptide
  Seed: NQHLCGSHL (INS_HUMAN)
NVHLCGSHF

SEQ ID NO: 36550 - protein, 11 aa, Artificial Sequence
  Description of Artificial Sequence: Synthetic peptide
  Seed: ALWGPDPAAAF (INS_HUMAN)
AAWGPDPAAAV

SEQ ID NO: 36551 - protein, 9 aa, Artificial Sequence
  Description of Artificial Sequence: Synthetic peptide
  Seed: RLLPLLALL (INS_HUMAN)
RFLPLLALR

SEQ ID NO: 36552 - protein, 11 aa, Artificial Sequence
  Description of Artificial Sequence: Synthetic peptide
  Seed: REAEDLQVGQV (INS_HUMAN)
RIAEDLQVGQI

SEQ ID NO: 36553 - protein, 10 aa, Artificial Sequence
  Description of Artificial Sequence: Synthetic peptide
  Seed: EALYLVCGER (INS_HUMAN)
ESLYLVCGEK

SEQ ID NO: 36554 - protein, 9 aa, Artificial Sequence
  Description of Artificial Sequence: Synthetic peptide
  Seed: AGSLQPLAL (INS_HUMAN)
APSLQPLAM

SEQ ID NO: 36555 - protein, 9 aa, Artificial Sequence
  Description of Artificial Sequence: Synthetic peptide
  Seed: WGPDPAAAF (INS_HUMAN)
WVPDPAAAI

SEQ ID NO: 36556 - protein, 9 aa, Artificial Sequence
  Description of Artificial Sequence: Synthetic peptide
  Seed: AEDLQVGQV (INS_HUMAN)
AADLQVGQF

SEQ ID NO: 36557 - protein, 11 aa, Artificial Sequence
  Description of Artificial Sequence: Synthetic peptide
  Seed: RGFFYTPKTRR (INS_HUMAN)
RAFFYTPKTRR

SEQ ID NO: 36558 - protein, 9 aa, Artificial Sequence
  Description of Artificial Sequence: Synthetic peptide
  Seed: RLLPLLALL (INS_HUMAN)
RALPLLALY

SEQ ID NO: 36559 - protein, 9 aa, Artificial Sequence
  Description of Artificial Sequence: Synthetic peptide
  Seed: AAAFVNQHL (INS_HUMAN)
AVAFVNQHI

SEQ ID NO: 36560 - protein, 10 aa, Artificial Sequence
  Description of Artificial Sequence: Synthetic peptide
  Seed: GIVEQCCTSI (INS_HUMAN)
GVVEQCCTSV

SEQ ID NO: 36561 - protein, 11 aa, Artificial Sequence
  Description of Artificial Sequence: Synthetic peptide
  Seed: VELGGGPGAGS (INS_HUMAN)
VELGGGPGAGA

SEQ ID NO: 36562 - protein, 8 aa, Artificial Sequence
  Description of Artificial Sequence: Synthetic peptide
  Seed: SLYQLENY (INS_HUMAN)
SQYQLENY

SEQ ID NO: 36563 - protein, 9 aa, Artificial Sequence
  Description of Artificial Sequence: Synthetic peptide
  Seed: WGPDPAAAF (INS_HUMAN)
WIPDPAAAF

SEQ ID NO: 36564 - protein, 9 aa, Artificial Sequence
  Description of Artificial Sequence: Synthetic peptide
  Seed: GPDPAAAFV (INS_HUMAN)
GGDPAAAFV

SEQ ID NO: 36565 - protein, 11 aa, Artificial Sequence
  Description of Artificial Sequence: Synthetic peptide
  Seed: GSHLVEALYLV (INS_HUMAN)
GSHLVEALYLI

SEQ ID NO: 36566 - protein, 8 aa, Artificial Sequence
  Description of Artificial Sequence: Synthetic peptide
  Seed: LWMRLLPL (INS_HUMAN)
LKMRLLPM

SEQ ID NO: 36567 - protein, 11 aa, Artificial Sequence
  Description of Artificial Sequence: Synthetic peptide
  Seed: ALWGPDPAAAF (INS_HUMAN)
AGWGPDPAAAW

SEQ ID NO: 36568 - protein, 11 aa, Artificial Sequence
  Description of Artificial Sequence: Synthetic peptide
  Seed: GSHLVEALYLV (INS_HUMAN)
GGHLVEALYLV

SEQ ID NO: 36569 - protein, 11 aa, Artificial Sequence
  Description of Artificial Sequence: Synthetic peptide
  Seed: SHLVEALYLVC (INS_HUMAN)
SLLVEALYLVY

SEQ ID NO: 36570 - protein, 10 aa, Artificial Sequence
  Description of Artificial Sequence: Synthetic peptide
  Seed: WMRLLPLLAL (INS_HUMAN)
WTRLLPLLAI

SEQ ID NO: 36571 - protein, 9 aa, Artificial Sequence
  Description of Artificial Sequence: Synthetic peptide
  Seed: WGPDPAAAF (INS_HUMAN)
WFPDPAAAV

SEQ ID NO: 36572 - protein, 9 aa, Artificial Sequence
  Description of Artificial Sequence: Synthetic peptide
  Seed: ALWMRLLPL (INS_HUMAN)
AVWMRLLPV

SEQ ID NO: 36573 - protein, 10 aa, Artificial Sequence
  Description of Artificial Sequence: Synthetic peptide
  Seed: SHLVEALYLV (INS_HUMAN)
SELVEALYLV

SEQ ID NO: 36574 - protein, 10 aa, Artificial Sequence
  Description of Artificial Sequence: Synthetic peptide
  Seed: HLVEALYLVC (INS_HUMAN)
HLVEALYLVE

SEQ ID NO: 36575 - protein, 9 aa, Artificial Sequence
  Description of Artificial Sequence: Synthetic peptide
  Seed: AEDLQVGQV (INS_HUMAN)
AEDLQVGQA

SEQ ID NO: 36576 - protein, 9 aa, Artificial Sequence
  Description of Artificial Sequence: Synthetic peptide
  Seed: GSHLVEALY (INS_HUMAN)
GYHLVEALY

SEQ ID NO: 36577 - protein, 10 aa, Artificial Sequence
  Description of Artificial Sequence: Synthetic peptide
  Seed: LWGPDPAAAF (INS_HUMAN)
LYGPDPAAAM

SEQ ID NO: 36578 - protein, 9 aa, Artificial Sequence
  Description of Artificial Sequence: Synthetic peptide
  Seed: LWMRLLPLL (INS_HUMAN)
LQMRLLPLY

SEQ ID NO: 36579 - protein, 9 aa, Artificial Sequence
  Description of Artificial Sequence: Synthetic peptide
  Seed: ALWMRLLPL (INS_HUMAN)
AAWMRLLPY

SEQ ID NO: 36580 - protein, 9 aa, Artificial Sequence
  Description of Artificial Sequence: Synthetic peptide
  Seed: MRLLPLLAL (INS_HUMAN)
MYLLPLLAF

SEQ ID NO: 36581 - protein, 9 aa, Artificial Sequence
  Description of Artificial Sequence: Synthetic peptide
  Seed: SLYQLENYC (INS_HUMAN)
STYQLENYV

SEQ ID NO: 36582 - protein, 10 aa, Artificial Sequence
  Description of Artificial Sequence: Synthetic peptide
  Seed: VNQHLCGSHL (INS_HUMAN)
VYQHLCGSHF

SEQ ID NO: 36583 - protein, 9 aa, Artificial Sequence
  Description of Artificial Sequence: Synthetic peptide
  Seed: MRLLPLLAL (INS_HUMAN)
MVLLPLLAF

SEQ ID NO: 36584 - protein, 10 aa, Artificial Sequence
  Description of Artificial Sequence: Synthetic peptide
  Seed: LWGPDPAAAF (INS_HUMAN)
LYGPDPAAAW

SEQ ID NO: 36585 - protein, 10 aa, Artificial Sequence
  Description of Artificial Sequence: Synthetic peptide
  Seed: HLCGSHLVEA (INS_HUMAN)
HMCGSHLVEI

SEQ ID NO: 36586 - protein, 10 aa, Artificial Sequence
  Description of Artificial Sequence: Synthetic peptide
  Seed: HLVEALYLVC (INS_HUMAN)
HMVEALYLVE

SEQ ID NO: 36587 - protein, 10 aa, Artificial Sequence
  Description of Artificial Sequence: Synthetic peptide
  Seed: WMRLLPLLAL (INS_HUMAN)
WRRLLPLLAR

SEQ ID NO: 36588 - protein, 9 aa, Artificial Sequence
  Description of Artificial Sequence: Synthetic peptide
  Seed: NQHLCGSHL (INS_HUMAN)
NHHLCGSHL

SEQ ID NO: 36589 - protein, 10 aa, Artificial Sequence
  Description of Artificial Sequence: Synthetic peptide
  Seed: VNQHLCGSHL (INS_HUMAN)
VFQHLCGSHF

SEQ ID NO: 36590 - protein, 9 aa, Artificial Sequence
  Description of Artificial Sequence: Synthetic peptide
  Seed: LALWGPDPA (INS_HUMAN)
LVLWGPDPI

SEQ ID NO: 36591 - protein, 11 aa, Artificial Sequence
  Description of Artificial Sequence: Synthetic peptide
  Seed: SHLVEALYLVC (INS_HUMAN)
SWLVEALYLVV

SEQ ID NO: 36592 - protein, 10 aa, Artificial Sequence
  Description of Artificial Sequence: Synthetic peptide
  Seed: MALWMRLLPL (INS_HUMAN)
MFLWMRLLPM

SEQ ID NO: 36593 - protein, 8 aa, Artificial Sequence
  Description of Artificial Sequence: Synthetic peptide
  Seed: RGFFYTPK (INS_HUMAN)
RIFFYTPR

SEQ ID NO: 36594 - protein, 11 aa, Artificial Sequence
  Description of Artificial Sequence: Synthetic peptide
  Seed: RLLPLLALLAL (INS_HUMAN)
RLLPLLALLAV

SEQ ID NO: 36595 - protein, 10 aa, Artificial Sequence
  Description of Artificial Sequence: Synthetic peptide
  Seed: WGPDPAAAFV (INS_HUMAN)
WPPDPAAAFM

SEQ ID NO: 36596 - protein, 10 aa, Artificial Sequence
  Description of Artificial Sequence: Synthetic peptide
  Seed: AEDLQVGQVE (INS_HUMAN)
AEDLQVGQVP

SEQ ID NO: 36597 - protein, 9 aa, Artificial Sequence
  Description of Artificial Sequence: Synthetic peptide
  Seed: AAAFVNQHL (INS_HUMAN)
ARAFVNQHY

SEQ ID NO: 36598 - protein, 10 aa, Artificial Sequence
  Description of Artificial Sequence: Synthetic peptide
  Seed: SHLVEALYLV (INS_HUMAN)
SKLVEALYLM

SEQ ID NO: 36599 - protein, 9 aa, Artificial Sequence
  Description of Artificial Sequence: Synthetic peptide
  Seed: LALEGSLQK (INS_HUMAN)
LSLEGSLQF

SEQ ID NO: 36600 - protein, 11 aa, Artificial Sequence
  Description of Artificial Sequence: Synthetic peptide
  Seed: MALWMRLLPLL (INS_HUMAN)
MQLWMRLLPLF

SEQ ID NO: 36601 - protein, 9 aa, Artificial Sequence
  Description of Artificial Sequence: Synthetic peptide
  Seed: NQHLCGSHL (INS_HUMAN)
NMHLCGSHF

SEQ ID NO: 36602 - protein, 9 aa, Artificial Sequence
  Description of Artificial Sequence: Synthetic peptide
  Seed: YLVCGERGF (INS_HUMAN)
YSVCGERGM

SEQ ID NO: 36603 - protein, 9 aa, Artificial Sequence
  Description of Artificial Sequence: Synthetic peptide
  Seed: HLVEALYLV (INS_HUMAN)
HIVEALYLM

SEQ ID NO: 36604 - protein, 8 aa, Artificial Sequence
  Description of Artificial Sequence: Synthetic peptide
  Seed: GPDPAAAF (INS_HUMAN)
GIDPAAAL

SEQ ID NO: 36605 - protein, 9 aa, Artificial Sequence
  Description of Artificial Sequence: Synthetic peptide
  Seed: LVCGERGFF (INS_HUMAN)
LTCGERGFF

SEQ ID NO: 36606 - protein, 10 aa, Artificial Sequence
  Description of Artificial Sequence: Synthetic peptide
  Seed: GIVEQCCTSI (INS_HUMAN)
GMVEQCCTSI

SEQ ID NO: 36607 - protein, 9 aa, Artificial Sequence
  Description of Artificial Sequence: Synthetic peptide
  Seed: YTPKTRREA (INS_HUMAN)
YVPKTRREI

SEQ ID NO: 36608 - protein, 10 aa, Artificial Sequence
  Description of Artificial Sequence: Synthetic peptide
  Seed: MALWMRLLPL (INS_HUMAN)
MWLWMRLLPI

SEQ ID NO: 36609 - protein, 10 aa, Artificial Sequence
  Description of Artificial Sequence: Synthetic peptide
  Seed: GIVEQCCTSI (INS_HUMAN)
GIVEQCCTSV

SEQ ID NO: 36610 - protein, 9 aa, Artificial Sequence
  Description of Artificial Sequence: Synthetic peptide
  Seed: AAFVNQHLC (INS_HUMAN)
AAFVNQHLY

SEQ ID NO: 36611 - protein, 9 aa, Artificial Sequence
  Description of Artificial Sequence: Synthetic peptide
  Seed: TSICSLYQL (INS_HUMAN)
TQICSLYQI

SEQ ID NO: 36612 - protein, 9 aa, Artificial Sequence
  Description of Artificial Sequence: Synthetic peptide
  Seed: CSLYQLENY (INS_HUMAN)
CSLYQLENW

SEQ ID NO: 36613 - protein, 10 aa, Artificial Sequence
  Description of Artificial Sequence: Synthetic peptide
  Seed: MRLLPLLALL (INS_HUMAN)
MKLLPLLALA

SEQ ID NO: 36614 - protein, 9 aa, Artificial Sequence
  Description of Artificial Sequence: Synthetic peptide
  Seed: FVNQHLCGS (INS_HUMAN)
FINQHLCGI

SEQ ID NO: 36615 - protein, 8 aa, Artificial Sequence
  Description of Artificial Sequence: Synthetic peptide
  Seed: LWMRLLPL (INS_HUMAN)
LRMRLLPL

SEQ ID NO: 36616 - protein, 9 aa, Artificial Sequence
  Description of Artificial Sequence: Synthetic peptide
  Seed: YLVCGERGF (INS_HUMAN)
YTVCGERGY

SEQ ID NO: 36617 - protein, 10 aa, Artificial Sequence
  Description of Artificial Sequence: Synthetic peptide
  Seed: ALWMRLLPLL (INS_HUMAN)
ALWMRLLPLT

SEQ ID NO: 36618 - protein, 9 aa, Artificial Sequence
  Description of Artificial Sequence: Synthetic peptide
  Seed: TSICSLYQL (INS_HUMAN)
TVICSLYQV

SEQ ID NO: 36619 - protein, 8 aa, Artificial Sequence
  Description of Artificial Sequence: Synthetic peptide
  Seed: GPDPAAAF (INS_HUMAN)
GVDPAAAM

SEQ ID NO: 36620 - protein, 10 aa, Artificial Sequence
  Description of Artificial Sequence: Synthetic peptide
  Seed: WMRLLPLLAL (INS_HUMAN)
WRRLLPLLAV

SEQ ID NO: 36621 - protein, 10 aa, Artificial Sequence
  Description of Artificial Sequence: Synthetic peptide
  Seed: LVCGERGFFY (INS_HUMAN)
LTCGERGFFY

SEQ ID NO: 36622 - protein, 9 aa, Artificial Sequence
  Description of Artificial Sequence: Synthetic peptide
  Seed: YTPKTRREA (INS_HUMAN)
YIPKTRREM

SEQ ID NO: 36623 - protein, 9 aa, Artificial Sequence
  Description of Artificial Sequence: Synthetic peptide
  Seed: WGPDPAAAF (INS_HUMAN)
WRPDPAAAF

SEQ ID NO: 36624 - protein, 8 aa, Artificial Sequence
  Description of Artificial Sequence: Synthetic peptide
  Seed: HLVEALYL (INS_HUMAN)
HQVEALYV

SEQ ID NO: 36625 - protein, 9 aa, Artificial Sequence
  Description of Artificial Sequence: Synthetic peptide
  Seed: TSICSLYQL (INS_HUMAN)
TAICSLYQW

SEQ ID NO: 36626 - protein, 11 aa, Artificial Sequence
  Description of Artificial Sequence: Synthetic peptide
  Seed: GSHLVEALYLV (INS_HUMAN)
GIHLVEALYLI

SEQ ID NO: 36627 - protein, 9 aa, Artificial Sequence
  Description of Artificial Sequence: Synthetic peptide
  Seed: ALWMRLLPL (INS_HUMAN)
AMWMRLLPW

SEQ ID NO: 36628 - protein, 9 aa, Artificial Sequence
  Description of Artificial Sequence: Synthetic peptide
  Seed: MRLLPLLAL (INS_HUMAN)
MALLPLLAF

SEQ ID NO: 36629 - protein, 10 aa, Artificial Sequence
  Description of Artificial Sequence: Synthetic peptide
  Seed: VNQHLCGSHL (INS_HUMAN)
VDQHLCGSHF

SEQ ID NO: 36630 - protein, 9 aa, Artificial Sequence
  Description of Artificial Sequence: Synthetic peptide
  Seed: GSHLVEALY (INS_HUMAN)
GSHLVEALW

SEQ ID NO: 36631 - protein, 10 aa, Artificial Sequence
  Description of Artificial Sequence: Synthetic peptide
  Seed: MRLLPLLALL (INS_HUMAN)
MNLLPLLALM

SEQ ID NO: 36632 - protein, 10 aa, Artificial Sequence
  Description of Artificial Sequence: Synthetic peptide
  Seed: MALWMRLLPL (INS_HUMAN)
MSLWMRLLPM

SEQ ID NO: 36633 - protein, 10 aa, Artificial Sequence
  Description of Artificial Sequence: Synthetic peptide
  Seed: LWMRLLPLLA (INS_HUMAN)
LMMRLLPLLI

SEQ ID NO: 36634 - protein, 10 aa, Artificial Sequence
  Description of Artificial Sequence: Synthetic peptide
  Seed: LLPLLALLAL (INS_HUMAN)
LAPLLALLAL

SEQ ID NO: 36635 - protein, 10 aa, Artificial Sequence
  Description of Artificial Sequence: Synthetic peptide
  Seed: WMRLLPLLAL (INS_HUMAN)
WQRLLPLLAY

SEQ ID NO: 36636 - protein, 10 aa, Artificial Sequence
  Description of Artificial Sequence: Synthetic peptide
  Seed: LLPLLALLAL (INS_HUMAN)
LNPLLALLAL

SEQ ID NO: 36637 - protein, 9 aa, Artificial Sequence
  Description of Artificial Sequence: Synthetic peptide
  Seed: ALWMRLLPL (INS_HUMAN)
AMWMRLLPC

SEQ ID NO: 36638 - protein, 9 aa, Artificial Sequence
  Description of Artificial Sequence: Synthetic peptide
  Seed: MRLLPLLAL (INS_HUMAN)
MGLLPLLAF

SEQ ID NO: 36639 - protein, 9 aa, Artificial Sequence
  Description of Artificial Sequence: Synthetic peptide
  Seed: ALWGPDPAA (INS_HUMAN)
AVWGPDPAL

SEQ ID NO: 36640 - protein, 11 aa, Artificial Sequence
  Description of Artificial Sequence: Synthetic peptide
  Seed: GSHLVEALYLV (INS_HUMAN)
GRHLVEALYLI

SEQ ID NO: 36641 - protein, 9 aa, Artificial Sequence
  Description of Artificial Sequence: Synthetic peptide
  Seed: GPDPAAAFV (INS_HUMAN)
GTDPAAAFI

SEQ ID NO: 36642 - protein, 9 aa, Artificial Sequence
  Description of Artificial Sequence: Synthetic peptide
  Seed: AGSLQPLAL (INS_HUMAN)
AVSLQPLAL

SEQ ID NO: 36643 - protein, 10 aa, Artificial Sequence
  Description of Artificial Sequence: Synthetic peptide
  Seed: VNQHLCGSHL (INS_HUMAN)
VNQHLCGSHF

SEQ ID NO: 36644 - protein, 9 aa, Artificial Sequence
  Description of Artificial Sequence: Synthetic peptide
  Seed: AEDLQVGQV (INS_HUMAN)
AADLQVGQI

SEQ ID NO: 36645 - protein, 11 aa, Artificial Sequence
  Description of Artificial Sequence: Synthetic peptide
  Seed: WMRLLPLLALL (INS_HUMAN)
WERLLPLLALL

SEQ ID NO: 36646 - protein, 9 aa, Artificial Sequence
  Description of Artificial Sequence: Synthetic peptide
  Seed: TSICSLYQL (INS_HUMAN)
TMICSLYQI

SEQ ID NO: 36647 - protein, 10 aa, Artificial Sequence
  Description of Artificial Sequence: Synthetic peptide
  Seed: MRLLPLLALL (INS_HUMAN)
MQLLPLLALI

SEQ ID NO: 36648 - protein, 11 aa, Artificial Sequence
  Description of Artificial Sequence: Synthetic peptide
  Seed: MRLLPLLALLA (INS_HUMAN)
MLLLPLLALLV

SEQ ID NO: 36649 - protein, 10 aa, Artificial Sequence
  Description of Artificial Sequence: Synthetic peptide
  Seed: MRLLPLLALL (INS_HUMAN)
MRLLPLLALC

SEQ ID NO: 36650 - protein, 9 aa, Artificial Sequence
  Description of Artificial Sequence: Synthetic peptide
  Seed: ALWMRLLPL (INS_HUMAN)
ARWMRLLPM

SEQ ID NO: 36651 - protein, 9 aa, Artificial Sequence
  Description of Artificial Sequence: Synthetic peptide
  Seed: ALWMRLLPL (INS_HUMAN)
ALWMRLLPM

SEQ ID NO: 36652 - protein, 10 aa, Artificial Sequence
  Description of Artificial Sequence: Synthetic peptide
  Seed: VNQHLCGSHL (INS_HUMAN)
VTQHLCGSHY

SEQ ID NO: 36653 - protein, 10 aa, Artificial Sequence
  Description of Artificial Sequence: Synthetic peptide
  Seed: WMRLLPLLAL (INS_HUMAN)
WDRLLPLLAI

SEQ ID NO: 36654 - protein, 9 aa, Artificial Sequence
  Description of Artificial Sequence: Synthetic peptide
  Seed: GPDPAAAFV (INS_HUMAN)
GLDPAAAFV

SEQ ID NO: 36655 - protein, 8 aa, Artificial Sequence
  Description of Artificial Sequence: Synthetic peptide
  Seed: RLLPLLAL (INS_HUMAN)
RLLPLLAV

SEQ ID NO: 36656 - protein, 10 aa, Artificial Sequence
  Description of Artificial Sequence: Synthetic peptide
  Seed: MRLLPLLALL (INS_HUMAN)
MWLLPLLALI

SEQ ID NO: 36657 - protein, 11 aa, Artificial Sequence
  Description of Artificial Sequence: Synthetic peptide
  Seed: LALWGPDPAAA (INS_HUMAN)
LPLWGPDPAAV

SEQ ID NO: 36658 - protein, 10 aa, Artificial Sequence
  Description of Artificial Sequence: Synthetic peptide
  Seed: AEDLQVGQVE (INS_HUMAN)
AEDLQVGQVI

SEQ ID NO: 36659 - protein, 11 aa, Artificial Sequence
  Description of Artificial Sequence: Synthetic peptide
  Seed: SHLVEALYLVC (INS_HUMAN)
SYLVEALYLVL

SEQ ID NO: 36660 - protein, 9 aa, Artificial Sequence
  Description of Artificial Sequence: Synthetic peptide
  Seed: RLLPLLALL (INS_HUMAN)
RVLPLLALF

SEQ ID NO: 36661 - protein, 9 aa, Artificial Sequence
  Description of Artificial Sequence: Synthetic peptide
  Seed: SLYQLENYC (INS_HUMAN)
SIYQLENYV

SEQ ID NO: 36662 - protein, 9 aa, Artificial Sequence
  Description of Artificial Sequence: Synthetic peptide
  Seed: RLLPLLALL (INS_HUMAN)
RALPLLALM

SEQ ID NO: 36663 - protein, 9 aa, Artificial Sequence
  Description of Artificial Sequence: Synthetic peptide
  Seed: ALWMRLLPL (INS_HUMAN)
ANWMRLLPY

SEQ ID NO: 36664 - protein, 9 aa, Artificial Sequence
  Description of Artificial Sequence: Synthetic peptide
  Seed: TSICSLYQL (INS_HUMAN)
TSICSLYQF

SEQ ID NO: 36665 - protein, 9 aa, Artificial Sequence
  Description of Artificial Sequence: Synthetic peptide
  Seed: HLVEALYLV (INS_HUMAN)
HQVEALYLW

SEQ ID NO: 36666 - protein, 9 aa, Artificial Sequence
  Description of Artificial Sequence: Synthetic peptide
  Seed: ALWMRLLPL (INS_HUMAN)
AIWMRLLPF

SEQ ID NO: 36667 - protein, 10 aa, Artificial Sequence
  Description of Artificial Sequence: Synthetic peptide
  Seed: SHLVEALYLV (INS_HUMAN)
SPLVEALYLA

SEQ ID NO: 36668 - protein, 9 aa, Artificial Sequence
  Description of Artificial Sequence: Synthetic peptide
  Seed: QPLALEGSL (INS_HUMAN)
QPLALEGSA

SEQ ID NO: 36669 - protein, 11 aa, Artificial Sequence
  Description of Artificial Sequence: Synthetic peptide
  Seed: SHLVEALYLVC (INS_HUMAN)
SKLVEALYLVV

SEQ ID NO: 36670 - protein, 10 aa, Artificial Sequence
  Description of Artificial Sequence: Synthetic peptide
  Seed: WMRLLPLLAL (INS_HUMAN)
WYRLLPLLAL

SEQ ID NO: 36671 - protein, 10 aa, Artificial Sequence
  Description of Artificial Sequence: Synthetic peptide
  Seed: CGSHLVEALY (INS_HUMAN)
CMSHLVEALY

SEQ ID NO: 36672 - protein, 9 aa, Artificial Sequence
  Description of Artificial Sequence: Synthetic peptide
  Seed: GPDPAAAFV (INS_HUMAN)
GVDPAAAFI

SEQ ID NO: 36673 - protein, 9 aa, Artificial Sequence
  Description of Artificial Sequence: Synthetic peptide
  Seed: RLLPLLALL (INS_HUMAN)
RMLPLLALV

SEQ ID NO: 36674 - protein, 11 aa, Artificial Sequence
  Description of Artificial Sequence: Synthetic peptide
  Seed: ALWGPDPAAAF (INS_HUMAN)
AMWGPDPAAAV

SEQ ID NO: 36675 - protein, 8 aa, Artificial Sequence
  Description of Artificial Sequence: Synthetic peptide
  Seed: LWMRLLPL (INS_HUMAN)
LMMRLLPI

SEQ ID NO: 36676 - protein, 9 aa, Artificial Sequence
  Description of Artificial Sequence: Synthetic peptide
  Seed: HLVEALYLV (INS_HUMAN)
HTVEALYLT

SEQ ID NO: 36677 - protein, 11 aa, Artificial Sequence
  Description of Artificial Sequence: Synthetic peptide
  Seed: SHLVEALYLVC (INS_HUMAN)
SLLVEALYLVT

SEQ ID NO: 36678 - protein, 10 aa, Artificial Sequence
  Description of Artificial Sequence: Synthetic peptide
  Seed: MALWMRLLPL (INS_HUMAN)
MQLWMRLLPV

SEQ ID NO: 36679 - protein, 11 aa, Artificial Sequence
  Description of Artificial Sequence: Synthetic peptide
  Seed: REAEDLQVGQV (INS_HUMAN)
RMAEDLQVGQF

SEQ ID NO: 36680 - protein, 9 aa, Artificial Sequence
  Description of Artificial Sequence: Synthetic peptide
  Seed: ALWGPDPAA (INS_HUMAN)
ALWGPDPAI

SEQ ID NO: 36681 - protein, 9 aa, Artificial Sequence
  Description of Artificial Sequence: Synthetic peptide
  Seed: TSICSLYQL (INS_HUMAN)
TTICSLYQT

SEQ ID NO: 36682 - protein, 9 aa, Artificial Sequence
  Description of Artificial Sequence: Synthetic peptide
  Seed: RLLPLLALL (INS_HUMAN)
RRLPLLALT

SEQ ID NO: 36683 - protein, 9 aa, Artificial Sequence
  Description of Artificial Sequence: Synthetic peptide
  Seed: AEDLQVGQV (INS_HUMAN)
ATDLQVGQV

SEQ ID NO: 36684 - protein, 11 aa, Artificial Sequence
  Description of Artificial Sequence: Synthetic peptide
  Seed: LWMRLLPLLAL (INS_HUMAN)
LYMRLLPLLAL

SEQ ID NO: 36685 - protein, 10 aa, Artificial Sequence
  Description of Artificial Sequence: Synthetic peptide
  Seed: HLVEALYLVC (INS_HUMAN)
HLVEALYLVQ

SEQ ID NO: 36686 - protein, 11 aa, Artificial Sequence
  Description of Artificial Sequence: Synthetic peptide
  Seed: ALWGPDPAAAF (INS_HUMAN)
AEWGPDPAAAY

SEQ ID NO: 36687 - protein, 11 aa, Artificial Sequence
  Description of Artificial Sequence: Synthetic peptide
  Seed: ALWGPDPAAAF (INS_HUMAN)
ASWGPDPAAAF

SEQ ID NO: 36688 - protein, 9 aa, Artificial Sequence
  Description of Artificial Sequence: Synthetic peptide
  Seed: RLLPLLALL (INS_HUMAN)
RSLPLLALI

SEQ ID NO: 36689 - protein, 11 aa, Artificial Sequence
  Description of Artificial Sequence: Synthetic peptide
  Seed: AEDLQVGQVEL (INS_HUMAN)
AEDLQVGQVEW

SEQ ID NO: 36690 - protein, 11 aa, Artificial Sequence
  Description of Artificial Sequence: Synthetic peptide
  Seed: GSHLVEALYLV (INS_HUMAN)
GMHLVEALYLA

SEQ ID NO: 36691 - protein, 11 aa, Artificial Sequence
  Description of Artificial Sequence: Synthetic peptide
  Seed: SHLVEALYLVC (INS_HUMAN)
SLLVEALYLVA

SEQ ID NO: 36692 - protein, 10 aa, Artificial Sequence
  Description of Artificial Sequence: Synthetic peptide
  Seed: SHLVEALYLV (INS_HUMAN)
SELVEALYLM

SEQ ID NO: 36693 - protein, 10 aa, Artificial Sequence
  Description of Artificial Sequence: Synthetic peptide
  Seed: RLLPLLALLA (INS_HUMAN)
RLLPLLALLG

SEQ ID NO: 36694 - protein, 10 aa, Artificial Sequence
  Description of Artificial Sequence: Synthetic peptide
  Seed: LLPLLALLAL (INS_HUMAN)
LDPLLALLAY

SEQ ID NO: 36695 - protein, 10 aa, Artificial Sequence
  Description of Artificial Sequence: Synthetic peptide
  Seed: MRLLPLLALL (INS_HUMAN)
MVLLPLLALM

SEQ ID NO: 36696 - protein, 11 aa, Artificial Sequence
  Description of Artificial Sequence: Synthetic peptide
  Seed: SHLVEALYLVC (INS_HUMAN)
SMLVEALYLVC

SEQ ID NO: 36697 - protein, 10 aa, Artificial Sequence
  Description of Artificial Sequence: Synthetic peptide
  Seed: WMRLLPLLAL (INS_HUMAN)
WERLLPLLAK

SEQ ID NO: 36698 - protein, 10 aa, Artificial Sequence
  Description of Artificial Sequence: Synthetic peptide
  Seed: SHLVEALYLV (INS_HUMAN)
SNLVEALYLV

SEQ ID NO: 36699 - protein, 9 aa, Artificial Sequence
  Description of Artificial Sequence: Synthetic peptide
  Seed: ALWMRLLPL (INS_HUMAN)
ARWMRLLPF

SEQ ID NO: 36700 - protein, 9 aa, Artificial Sequence
  Description of Artificial Sequence: Synthetic peptide
  Seed: ALWMRLLPL (INS_HUMAN)
AQWMRLLPH

SEQ ID NO: 36701 - protein, 10 aa, Artificial Sequence
  Description of Artificial Sequence: Synthetic peptide
  Seed: MRLLPLLALL (INS_HUMAN)
MFLLPLLALI

SEQ ID NO: 36702 - protein, 11 aa, Artificial Sequence
  Description of Artificial Sequence: Synthetic peptide
  Seed: RGFFYTPKTRR (INS_HUMAN)
RPFFYTPKTRR

SEQ ID NO: 36703 - protein, 10 aa, Artificial Sequence
  Description of Artificial Sequence: Synthetic peptide
  Seed: SHLVEALYLV (INS_HUMAN)
SWLVEALYLA

SEQ ID NO: 36704 - protein, 10 aa, Artificial Sequence
  Description of Artificial Sequence: Synthetic peptide
  Seed: HLVEALYLVC (INS_HUMAN)
HLVEALYLVV

SEQ ID NO: 36705 - protein, 11 aa, Artificial Sequence
  Description of Artificial Sequence: Synthetic peptide
  Seed: GSHLVEALYLV (INS_HUMAN)
GQHLVEALYLI

SEQ ID NO: 36706 - protein, 11 aa, Artificial Sequence
  Description of Artificial Sequence: Synthetic peptide
  Seed: HLCGSHLVEAL (INS_HUMAN)
HQCGSHLVEAF

SEQ ID NO: 36707 - protein, 9 aa, Artificial Sequence
  Description of Artificial Sequence: Synthetic peptide
  Seed: TSICSLYQL (INS_HUMAN)
TMICSLYQW

SEQ ID NO: 36708 - protein, 8 aa, Artificial Sequence
  Description of Artificial Sequence: Synthetic peptide
  Seed: AAFVNQHL (INS_HUMAN)
AQFVNQHI

SEQ ID NO: 36709 - protein, 9 aa, Artificial Sequence
  Description of Artificial Sequence: Synthetic peptide
  Seed: MRLLPLLAL (INS_HUMAN)
MRLLPLLAR

SEQ ID NO: 36710 - protein, 10 aa, Artificial Sequence
  Description of Artificial Sequence: Synthetic peptide
  Seed: MALWMRLLPL (INS_HUMAN)
MHLWMRLLPY

SEQ ID NO: 36711 - protein, 9 aa, Artificial Sequence
  Description of Artificial Sequence: Synthetic peptide
  Seed: ALWGPDPAA (INS_HUMAN)
ALWGPDPAV

SEQ ID NO: 36712 - protein, 11 aa, Artificial Sequence
  Description of Artificial Sequence: Synthetic peptide
  Seed: MALWMRLLPLL (INS_HUMAN)
MMLWMRLLPLV

SEQ ID NO: 36713 - protein, 11 aa, Artificial Sequence
  Description of Artificial Sequence: Synthetic peptide
  Seed: RLLPLLALLAL (INS_HUMAN)
RMLPLLALLAW

SEQ ID NO: 36714 - protein, 9 aa, Artificial Sequence
  Description of Artificial Sequence: Synthetic peptide
  Seed: AAAFVNQHL (INS_HUMAN)
ARAFVNQHM

SEQ ID NO: 36715 - protein, 10 aa, Artificial Sequence
  Description of Artificial Sequence: Synthetic peptide
  Seed: MRLLPLLALL (INS_HUMAN)
MRLLPLLALR

SEQ ID NO: 36716 - protein, 9 aa, Artificial Sequence
  Description of Artificial Sequence: Synthetic peptide
  Seed: TSICSLYQL (INS_HUMAN)
TLICSLYQL

SEQ ID NO: 36717 - protein, 9 aa, Artificial Sequence
  Description of Artificial Sequence: Synthetic peptide
  Seed: WGPDPAAAF (INS_HUMAN)
WAPDPAAAV

SEQ ID NO: 36718 - protein, 10 aa, Artificial Sequence
  Description of Artificial Sequence: Synthetic peptide
  Seed: MRLLPLLALL (INS_HUMAN)
MYLLPLLALA

SEQ ID NO: 36719 - protein, 9 aa, Artificial Sequence
  Description of Artificial Sequence: Synthetic peptide
  Seed: AAFVNQHLC (INS_HUMAN)
ASFVNQHLM

SEQ ID NO: 36720 - protein, 10 aa, Artificial Sequence
  Description of Artificial Sequence: Synthetic peptide
  Seed: WMRLLPLLAL (INS_HUMAN)
WCRLLPLLAL

SEQ ID NO: 36721 - protein, 9 aa, Artificial Sequence
  Description of Artificial Sequence: Synthetic peptide
  Seed: AAAFVNQHL (INS_HUMAN)
AVAFVNQHL

SEQ ID NO: 36722 - protein, 11 aa, Artificial Sequence
  Description of Artificial Sequence: Synthetic peptide
  Seed: WMRLLPLLALL (INS_HUMAN)
WCRLLPLLALV

SEQ ID NO: 36723 - protein, 10 aa, Artificial Sequence
  Description of Artificial Sequence: Synthetic peptide
  Seed: MALWMRLLPL (INS_HUMAN)
MRLWMRLLPI

SEQ ID NO: 36724 - protein, 10 aa, Artificial Sequence
  Description of Artificial Sequence: Synthetic peptide
  Seed: VNQHLCGSHL (INS_HUMAN)
VDQHLCGSHY

SEQ ID NO: 36725 - protein, 9 aa, Artificial Sequence
  Description of Artificial Sequence: Synthetic peptide
  Seed: VELGGGPGA (INS_HUMAN)
VELGGGPGI

SEQ ID NO: 36726 - protein, 11 aa, Artificial Sequence
  Description of Artificial Sequence: Synthetic peptide
  Seed: MALWMRLLPLL (INS_HUMAN)
MSLWMRLLPLM

SEQ ID NO: 36727 - protein, 10 aa, Artificial Sequence
  Description of Artificial Sequence: Synthetic peptide
  Seed: RGFFYTPKTR (INS_HUMAN)
RTFFYTPKTV

SEQ ID NO: 36728 - protein, 9 aa, Artificial Sequence
  Description of Artificial Sequence: Synthetic peptide
  Seed: AEDLQVGQV (INS_HUMAN)
AQDLQVGQL

SEQ ID NO: 36729 - protein, 11 aa, Artificial Sequence
  Description of Artificial Sequence: Synthetic peptide
  Seed: SLQPLALEGSL (INS_HUMAN)
SPQPLALEGSL

SEQ ID NO: 36730 - protein, 11 aa, Artificial Sequence
  Description of Artificial Sequence: Synthetic peptide
  Seed: WMRLLPLLALL (INS_HUMAN)
WKRLLPLLALL

SEQ ID NO: 36731 - protein, 9 aa, Artificial Sequence
  Description of Artificial Sequence: Synthetic peptide
  Seed: AEDLQVGQV (INS_HUMAN)
AEDLQVGQI

SEQ ID NO: 36732 - protein, 9 aa, Artificial Sequence
  Description of Artificial Sequence: Synthetic peptide
  Seed: AAAFVNQHL (INS_HUMAN)
AIAFVNQHV

SEQ ID NO: 36733 - protein, 11 aa, Artificial Sequence
  Description of Artificial Sequence: Synthetic peptide
  Seed: SHLVEALYLVC (INS_HUMAN)
SMLVEALYLVG

SEQ ID NO: 36734 - protein, 9 aa, Artificial Sequence
  Description of Artificial Sequence: Synthetic peptide
  Seed: AEDLQVGQV (INS_HUMAN)
AADLQVGQL

SEQ ID NO: 36735 - protein, 10 aa, Artificial Sequence
  Description of Artificial Sequence: Synthetic peptide
  Seed: RLLPLLALLA (INS_HUMAN)
RQLPLLALLI

SEQ ID NO: 36736 - protein, 10 aa, Artificial Sequence
  Description of Artificial Sequence: Synthetic peptide
  Seed: VNQHLCGSHL (INS_HUMAN)
VMQHLCGSHM

SEQ ID NO: 36737 - protein, 11 aa, Artificial Sequence
  Description of Artificial Sequence: Synthetic peptide
  Seed: ALWGPDPAAAF (INS_HUMAN)
AMWGPDPAAAY

SEQ ID NO: 36738 - protein, 9 aa, Artificial Sequence
  Description of Artificial Sequence: Synthetic peptide
  Seed: LALWGPDPA (INS_HUMAN)
LALWGPDPV

SEQ ID NO: 36739 - protein, 9 aa, Artificial Sequence
  Description of Artificial Sequence: Synthetic peptide
  Seed: FVNQHLCGS (INS_HUMAN)
FINQHLCGA

SEQ ID NO: 36740 - protein, 9 aa, Artificial Sequence
  Description of Artificial Sequence: Synthetic peptide
  Seed: FVNQHLCGS (INS_HUMAN)
FVNQHLCGM

SEQ ID NO: 36741 - protein, 8 aa, Artificial Sequence
  Description of Artificial Sequence: Synthetic peptide
  Seed: GPDPAAAF (INS_HUMAN)
GTDPAAAI

SEQ ID NO: 36742 - protein, 10 aa, Artificial Sequence
  Description of Artificial Sequence: Synthetic peptide
  Seed: RGFFYTPKTR (INS_HUMAN)
RQFFYTPKTK

SEQ ID NO: 36743 - protein, 9 aa, Artificial Sequence
  Description of Artificial Sequence: Synthetic peptide
  Seed: RLLPLLALL (INS_HUMAN)
RFLPLLALI

SEQ ID NO: 36744 - protein, 10 aa, Artificial Sequence
  Description of Artificial Sequence: Synthetic peptide
  Seed: LALWGPDPAA (INS_HUMAN)
LPLWGPDPAM

SEQ ID NO: 36745 - protein, 9 aa, Artificial Sequence
  Description of Artificial Sequence: Synthetic peptide
  Seed: ALWMRLLPL (INS_HUMAN)
ALWMRLLPR

SEQ ID NO: 36746 - protein, 9 aa, Artificial Sequence
  Description of Artificial Sequence: Synthetic peptide
  Seed: CCTSICSLY (INS_HUMAN)
CSTSICSLY

SEQ ID NO: 36747 - protein, 11 aa, Artificial Sequence
  Description of Artificial Sequence: Synthetic peptide
  Seed: LWMRLLPLLAL (INS_HUMAN)
LRMRLLPLLAM

SEQ ID NO: 36748 - protein, 9 aa, Artificial Sequence
  Description of Artificial Sequence: Synthetic peptide
  Seed: AAFVNQHLC (INS_HUMAN)
AAFVNQHLW

SEQ ID NO: 36749 - protein, 9 aa, Artificial Sequence
  Description of Artificial Sequence: Synthetic peptide
  Seed: GGGPGAGSL (INS_HUMAN)
GSGPGAGSY

SEQ ID NO: 36750 - protein, 9 aa, Artificial Sequence
  Description of Artificial Sequence: Synthetic peptide
  Seed: RLLPLLALL (INS_HUMAN)
RALPLLALV

SEQ ID NO: 36751 - protein, 11 aa, Artificial Sequence
  Description of Artificial Sequence: Synthetic peptide
  Seed: SHLVEALYLVC (INS_HUMAN)
SALVEALYLVV

SEQ ID NO: 36752 - protein, 9 aa, Artificial Sequence
  Description of Artificial Sequence: Synthetic peptide
  Seed: CCTSICSLY (INS_HUMAN)
CQTSICSLY

SEQ ID NO: 36753 - protein, 11 aa, Artificial Sequence
  Description of Artificial Sequence: Synthetic peptide
  Seed: AEDLQVGQVEL (INS_HUMAN)
AEDLQVGQVEA

SEQ ID NO: 36754 - protein, 9 aa, Artificial Sequence
  Description of Artificial Sequence: Synthetic peptide
  Seed: RLLPLLALL (INS_HUMAN)
RILPLLALR

SEQ ID NO: 36755 - protein, 10 aa, Artificial Sequence
  Description of Artificial Sequence: Synthetic peptide
  Seed: MRLLPLLALL (INS_HUMAN)
MLLLPLLALM

SEQ ID NO: 36756 - protein, 9 aa, Artificial Sequence
  Description of Artificial Sequence: Synthetic peptide
  Seed: RLLPLLALL (INS_HUMAN)
RLLPLLALW

SEQ ID NO: 36757 - protein, 10 aa, Artificial Sequence
  Description of Artificial Sequence: Synthetic peptide
  Seed: SHLVEALYLV (INS_HUMAN)
SALVEALYLL

SEQ ID NO: 36758 - protein, 10 aa, Artificial Sequence
  Description of Artificial Sequence: Synthetic peptide
  Seed: LALWGPDPAA (INS_HUMAN)
LQLWGPDPAV

SEQ ID NO: 36759 - protein, 9 aa, Artificial Sequence
  Description of Artificial Sequence: Synthetic peptide
  Seed: RLLPLLALL (INS_HUMAN)
RILPLLALW

SEQ ID NO: 36760 - protein, 10 aa, Artificial Sequence
  Description of Artificial Sequence: Synthetic peptide
  Seed: RGFFYTPKTR (INS_HUMAN)
RNFFYTPKTR

SEQ ID NO: 36761 - protein, 8 aa, Artificial Sequence
  Description of Artificial Sequence: Synthetic peptide
  Seed: LWMRLLPL (INS_HUMAN)
LPMRLLPL

SEQ ID NO: 36762 - protein, 9 aa, Artificial Sequence
  Description of Artificial Sequence: Synthetic peptide
  Seed: FFYTPKTRR (INS_HUMAN)
FYYTPKTRR

SEQ ID NO: 36763 - protein, 9 aa, Artificial Sequence
  Description of Artificial Sequence: Synthetic peptide
  Seed: ALWMRLLPL (INS_HUMAN)
AVWMRLLPY

SEQ ID NO: 36764 - protein, 11 aa, Artificial Sequence
  Description of Artificial Sequence: Synthetic peptide
  Seed: SHLVEALYLVC (INS_HUMAN)
SKLVEALYLVI

SEQ ID NO: 36765 - protein, 8 aa, Artificial Sequence
  Description of Artificial Sequence: Synthetic peptide
  Seed: LLPLLALL (INS_HUMAN)
LMPLLALV

SEQ ID NO: 36766 - protein, 10 aa, Artificial Sequence
  Description of Artificial Sequence: Synthetic peptide
  Seed: LWMRLLPLLA (INS_HUMAN)
LMMRLLPLLL

SEQ ID NO: 36767 - protein, 10 aa, Artificial Sequence
  Description of Artificial Sequence: Synthetic peptide
  Seed: SHLVEALYLV (INS_HUMAN)
SYLVEALYLA

SEQ ID NO: 36768 - protein, 10 aa, Artificial Sequence
  Description of Artificial Sequence: Synthetic peptide
  Seed: LLPLLALLAL (INS_HUMAN)
LWPLLALLAY

SEQ ID NO: 36769 - protein, 9 aa, Artificial Sequence
  Description of Artificial Sequence: Synthetic peptide
  Seed: AAAFVNQHL (INS_HUMAN)
ALAFVNQHV

SEQ ID NO: 36770 - protein, 9 aa, Artificial Sequence
  Description of Artificial Sequence: Synthetic peptide
  Seed: RLLPLLALL (INS_HUMAN)
RYLPLLALW

SEQ ID NO: 36771 - protein, 9 aa, Artificial Sequence
  Description of Artificial Sequence: Synthetic peptide
  Seed: LVCGERGFF (INS_HUMAN)
LMCGERGFY

SEQ ID NO: 36772 - protein, 10 aa, Artificial Sequence
  Description of Artificial Sequence: Synthetic peptide
  Seed: SHLVEALYLV (INS_HUMAN)
SGLVEALYLV

SEQ ID NO: 36773 - protein, 8 aa, Artificial Sequence
  Description of Artificial Sequence: Synthetic peptide
  Seed: LVEALYLV (INS_HUMAN)
LMEALYLI

SEQ ID NO: 36774 - protein, 10 aa, Artificial Sequence
  Description of Artificial Sequence: Synthetic peptide
  Seed: WMRLLPLLAL (INS_HUMAN)
WQRLLPLLAF

SEQ ID NO: 36775 - protein, 9 aa, Artificial Sequence
  Description of Artificial Sequence: Synthetic peptide
  Seed: MALWMRLLP (INS_HUMAN)
MALWMRLLA

SEQ ID NO: 36776 - protein, 10 aa, Artificial Sequence
  Description of Artificial Sequence: Synthetic peptide
  Seed: VNQHLCGSHL (INS_HUMAN)
VNQHLCGSHY

SEQ ID NO: 36777 - protein, 10 aa, Artificial Sequence
  Description of Artificial Sequence: Synthetic peptide
  Seed: HLVEALYLVC (INS_HUMAN)
HQVEALYLVA

SEQ ID NO: 36778 - protein, 9 aa, Artificial Sequence
  Description of Artificial Sequence: Synthetic peptide
  Seed: AAFVNQHLC (INS_HUMAN)
ATFVNQHLI

SEQ ID NO: 36779 - protein, 10 aa, Artificial Sequence
  Description of Artificial Sequence: Synthetic peptide
  Seed: LLALWGPDPA (INS_HUMAN)
LQALWGPDPV

SEQ ID NO: 36780 - protein, 11 aa, Artificial Sequence
  Description of Artificial Sequence: Synthetic peptide
  Seed: SHLVEALYLVC (INS_HUMAN)
SLLVEALYLVI

SEQ ID NO: 36781 - protein, 9 aa, Artificial Sequence
  Description of Artificial Sequence: Synthetic peptide
  Seed: QPLALEGSL (INS_HUMAN)
QALALEGSY

SEQ ID NO: 36782 - protein, 11 aa, Artificial Sequence
  Description of Artificial Sequence: Synthetic peptide
  Seed: RGFFYTPKTRR (INS_HUMAN)
RWFFYTPKTRR

SEQ ID NO: 36783 - protein, 11 aa, Artificial Sequence
  Description of Artificial Sequence: Synthetic peptide
  Seed: RGFFYTPKTRR (INS_HUMAN)
RNFFYTPKTRR

SEQ ID NO: 36784 - protein, 10 aa, Artificial Sequence
  Description of Artificial Sequence: Synthetic peptide
  Seed: MALWMRLLPL (INS_HUMAN)
MCLWMRLLPV

SEQ ID NO: 36785 - protein, 11 aa, Artificial Sequence
  Description of Artificial Sequence: Synthetic peptide
  Seed: ALWGPDPAAAF (INS_HUMAN)
AMWGPDPAAAF

SEQ ID NO: 36786 - protein, 10 aa, Artificial Sequence
  Description of Artificial Sequence: Synthetic peptide
  Seed: LVCGERGFFY (INS_HUMAN)
LTCGERGFFK

SEQ ID NO: 36787 - protein, 9 aa, Artificial Sequence
  Description of Artificial Sequence: Synthetic peptide
  Seed: ALWMRLLPL (INS_HUMAN)
AIWMRLLPM

SEQ ID NO: 36788 - protein, 9 aa, Artificial Sequence
  Description of Artificial Sequence: Synthetic peptide
  Seed: LWMRLLPLL (INS_HUMAN)
LYMRLLPLY

SEQ ID NO: 36789 - protein, 9 aa, Artificial Sequence
  Description of Artificial Sequence: Synthetic peptide
  Seed: AAAFVNQHL (INS_HUMAN)
ASAFVNQHL

SEQ ID NO: 36790 - protein, 9 aa, Artificial Sequence
  Description of Artificial Sequence: Synthetic peptide
  Seed: AEDLQVGQV (INS_HUMAN)
ALDLQVGQM

SEQ ID NO: 36791 - protein, 10 aa, Artificial Sequence
  Description of Artificial Sequence: Synthetic peptide
  Seed: SHLVEALYLV (INS_HUMAN)
SCLVEALYLV

SEQ ID NO: 36792 - protein, 9 aa, Artificial Sequence
  Description of Artificial Sequence: Synthetic peptide
  Seed: ALWMRLLPL (INS_HUMAN)
AIWMRLLPI

SEQ ID NO: 36793 - protein, 10 aa, Artificial Sequence
  Description of Artificial Sequence: Synthetic peptide
  Seed: GIVEQCCTSI (INS_HUMAN)
GMVEQCCTSV

SEQ ID NO: 36794 - protein, 10 aa, Artificial Sequence
  Description of Artificial Sequence: Synthetic peptide
  Seed: SHLVEALYLV (INS_HUMAN)
SFLVEALYLV

SEQ ID NO: 36795 - protein, 11 aa, Artificial Sequence
  Description of Artificial Sequence: Synthetic peptide
  Seed: WMRLLPLLALL (INS_HUMAN)
WHRLLPLLALL

SEQ ID NO: 36796 - protein, 11 aa, Artificial Sequence
  Description of Artificial Sequence: Synthetic peptide
  Seed: HLCGSHLVEAL (INS_HUMAN)
HACGSHLVEAY

SEQ ID NO: 36797 - protein, 9 aa, Artificial Sequence
  Description of Artificial Sequence: Synthetic peptide
  Seed: GPDPAAAFV (INS_HUMAN)
GTDPAAAFV

SEQ ID NO: 36798 - protein, 9 aa, Artificial Sequence
  Description of Artificial Sequence: Synthetic peptide
  Seed: HLVEALYLV (INS_HUMAN)
HVVEALYLM

SEQ ID NO: 36799 - protein, 9 aa, Artificial Sequence
  Description of Artificial Sequence: Synthetic peptide
  Seed: AAFVNQHLC (INS_HUMAN)
ANFVNQHLW

SEQ ID NO: 36800 - protein, 10 aa, Artificial Sequence
  Description of Artificial Sequence: Synthetic peptide
  Seed: LLPLLALLAL (INS_HUMAN)
LFPLLALLAM

SEQ ID NO: 36801 - protein, 10 aa, Artificial Sequence
  Description of Artificial Sequence: Synthetic peptide
  Seed: ALWMRLLPLL (INS_HUMAN)
ATWMRLLPLF

SEQ ID NO: 36802 - protein, 11 aa, Artificial Sequence
  Description of Artificial Sequence: Synthetic peptide
  Seed: ALWGPDPAAAF (INS_HUMAN)
ASWGPDPAAAM

SEQ ID NO: 36803 - protein, 9 aa, Artificial Sequence
  Description of Artificial Sequence: Synthetic peptide
  Seed: KTRREAEDL (INS_HUMAN)
KTRREAEDF

SEQ ID NO: 36804 - protein, 9 aa, Artificial Sequence
  Description of Artificial Sequence: Synthetic peptide
  Seed: RLLPLLALL (INS_HUMAN)
RGLPLLALK

SEQ ID NO: 36805 - protein, 9 aa, Artificial Sequence
  Description of Artificial Sequence: Synthetic peptide
  Seed: MRLLPLLAL (INS_HUMAN)
MRLLPLLAK

SEQ ID NO: 36806 - protein, 9 aa, Homo sapiens
  Native (INS_HUMAN)
SLYQLENYC

SEQ ID NO: 36807 - protein, 10 aa, Homo sapiens
  Native (INS_HUMAN)
SHLVEALYLV

SEQ ID NO: 36808 - protein, 8 aa, Homo sapiens
  Native (INS_HUMAN)
EDLQVGQV

SEQ ID NO: 36809 - protein, 8 aa, Homo sapiens
  Native (INS_HUMAN)
GSLQPLAL

SEQ ID NO: 36810 - protein, 9 aa, Homo sapiens
  Native (INS_HUMAN)
NQHLCGSHL

SEQ ID NO: 36811 - protein, 11 aa, Homo sapiens
  Native (INS_HUMAN)
SHLVEALYLVC

SEQ ID NO: 36812 - protein, 8 aa, Homo sapiens
  Native (INS_HUMAN)
VEQCCTSI

SEQ ID NO: 36813 - protein, 10 aa, Homo sapiens
  Native (INS_HUMAN)
LALWGPDPAA

SEQ ID NO: 36814 - protein, 8 aa, Homo sapiens
  Native (INS_HUMAN)
MALWMRLL

SEQ ID NO: 36815 - protein, 9 aa, Homo sapiens
  Native (INS_HUMAN)
AEDLQVGQV

SEQ ID NO: 36816 - protein, 9 aa, Homo sapiens
  Native (INS_HUMAN)
VEQCCTSIC

SEQ ID NO: 36817 - protein, 8 aa, Homo sapiens
  Native (INS_HUMAN)
HLVEALYL

SEQ ID NO: 36818 - protein, 8 aa, Homo sapiens
  Native (INS_HUMAN)
WMRLLPLL

SEQ ID NO: 36819 - protein, 11 aa, Homo sapiens
  Native (INS_HUMAN)
GGGPGAGSLQP

SEQ ID NO: 36820 - protein, 11 aa, Homo sapiens
  Native (INS_HUMAN)
LCGSHLVEALY

SEQ ID NO: 36821 - protein, 8 aa, Homo sapiens
  Native (INS_HUMAN)
LLALLALW

SEQ ID NO: 36822 - protein, 8 aa, Homo sapiens
  Native (INS_HUMAN)
LLPLLALL

SEQ ID NO: 36823 - protein, 8 aa, Homo sapiens
  Native (INS_HUMAN)
GAGSLQPL

SEQ ID NO: 36824 - protein, 8 aa, Homo sapiens
  Native (INS_HUMAN)
MRLLPLLA

SEQ ID NO: 36825 - protein, 9 aa, Homo sapiens
  Native (INS_HUMAN)
ERGFFYTPK

SEQ ID NO: 36826 - protein, 10 aa, Homo sapiens
  Native (INS_HUMAN)
MRLLPLLALL

SEQ ID NO: 36827 - protein, 10 aa, Homo sapiens
  Native (INS_HUMAN)
REAEDLQVGQ

SEQ ID NO: 36828 - protein, 10 aa, Homo sapiens
  Native (INS_HUMAN)
RLLPLLALLA

SEQ ID NO: 36829 - protein, 8 aa, Homo sapiens
  Native (INS_HUMAN)
RGFFYTPK

SEQ ID NO: 36830 - protein, 9 aa, Homo sapiens
  Native (INS_HUMAN)
IVEQCCTSI

SEQ ID NO: 36831 - protein, 8 aa, Homo sapiens
  Native (INS_HUMAN)
TPKTRREA

SEQ ID NO: 36832 - protein, 8 aa, Homo sapiens
  Native (INS_HUMAN)
GSHLVEAL

SEQ ID NO: 36833 - protein, 10 aa, Homo sapiens
  Native (INS_HUMAN)
CGSHLVEALY

SEQ ID NO: 36834 - protein, 11 aa, Homo sapiens
  Native (INS_HUMAN)
LGGGPGAGSLQ

SEQ ID NO: 36835 - protein, 10 aa, Homo sapiens
  Native (INS_HUMAN)
LLALWGPDPA

SEQ ID NO: 36836 - protein, 9 aa, Homo sapiens
  Native (INS_HUMAN)
RREAEDLQV

SEQ ID NO: 36837 - protein, 11 aa, Homo sapiens
  Native (INS_HUMAN)
SLQPLALEGSL

SEQ ID NO: 36838 - protein, 10 aa, Homo sapiens
  Native (INS_HUMAN)
HLCGSHLVEA

SEQ ID NO: 36839 - protein, 11 aa, Homo sapiens
  Native (INS_HUMAN)
FVNQHLCGSHL

SEQ ID NO: 36840 - protein, 9 aa, Homo sapiens
  Native (INS_HUMAN)
VEALYLVCG

SEQ ID NO: 36841 - protein, 10 aa, Homo sapiens
  Native (INS_HUMAN)
MALWMRLLPL

SEQ ID NO: 36842 - protein, 11 aa, Homo sapiens
  Native (INS_HUMAN)
TPKTRREAEDL

SEQ ID NO: 36843 - protein, 9 aa, Homo sapiens
  Native (INS_HUMAN)
WGPDPAAAF

SEQ ID NO: 36844 - protein, 11 aa, Homo sapiens
  Native (INS_HUMAN)
RLLPLLALLAL

SEQ ID NO: 36845 - protein, 8 aa, Homo sapiens
  Native (INS_HUMAN)
AAFVNQHL

SEQ ID NO: 36846 - protein, 11 aa, Homo sapiens
  Native (INS_HUMAN)
HLCGSHLVEAL

SEQ ID NO: 36847 - protein, 10 aa, Homo sapiens
  Native (INS_HUMAN)
HLVEALYLVC

SEQ ID NO: 36848 - protein, 11 aa, Homo sapiens
  Native (INS_HUMAN)
VEQCCTSICSL

SEQ ID NO: 36849 - protein, 11 aa, Homo sapiens
  Native (INS_HUMAN)
ALYLVCGERGF

SEQ ID NO: 36850 - protein, 10 aa, Homo sapiens
  Native (INS_HUMAN)
GIVEQCCTSI

SEQ ID NO: 36851 - protein, 9 aa, Homo sapiens
  Native (INS_HUMAN)
YLVCGERGF

SEQ ID NO: 36852 - protein, 11 aa, Homo sapiens
  Native (INS_HUMAN)
EQCCTSICSLY

SEQ ID NO: 36853 - protein, 8 aa, Homo sapiens
  Native (INS_HUMAN)
LQVGQVEL

SEQ ID NO: 36854 - protein, 8 aa, Homo sapiens
  Native (INS_HUMAN)
AAAFVNQH

SEQ ID NO: 36855 - protein, 8 aa, Homo sapiens
  Native (INS_HUMAN)
SLYQLENY

SEQ ID NO: 36856 - protein, 11 aa, Homo sapiens
  Native (INS_HUMAN)
GGPGAGSLQPL

SEQ ID NO: 36857 - protein, 10 aa, Homo sapiens
  Native (INS_HUMAN)
QCCTSICSLY

SEQ ID NO: 36858 - protein, 10 aa, Homo sapiens
  Native (INS_HUMAN)
RGFFYTPKTR

SEQ ID NO: 36859 - protein, 8 aa, Homo sapiens
  Native (INS_HUMAN)
GPDPAAAF

SEQ ID NO: 36860 - protein, 10 aa, Homo sapiens
  Native (INS_HUMAN)
TRREAEDLQV

SEQ ID NO: 36861 - protein, 9 aa, Homo sapiens
  Native (INS_HUMAN)
ALEGSLQKR

SEQ ID NO: 36862 - protein, 9 aa, Homo sapiens
  Native (INS_HUMAN)
LVCGERGFF

SEQ ID NO: 36863 - protein, 9 aa, Homo sapiens
  Native (INS_HUMAN)
GFFYTPKTR

SEQ ID NO: 36864 - protein, 9 aa, Homo sapiens
  Native (INS_HUMAN)
WMRLLPLLA

SEQ ID NO: 36865 - protein, 11 aa, Homo sapiens
  Native (INS_HUMAN)
GSHLVEALYLV

SEQ ID NO: 36866 - protein, 11 aa, Homo sapiens
  Native (INS_HUMAN)
LWMRLLPLLAL

SEQ ID NO: 36867 - protein, 10 aa, Homo sapiens
  Native (INS_HUMAN)
EDLQVGQVEL

SEQ ID NO: 36868 - protein, 9 aa, Homo sapiens
  Native (INS_HUMAN)
AAFVNQHLC

SEQ ID NO: 36869 - protein, 10 aa, Homo sapiens
  Native (INS_HUMAN)
GAGSLQPLAL

SEQ ID NO: 36870 - protein, 8 aa, Homo sapiens
  Native (INS_HUMAN)
REAEDLQV

SEQ ID NO: 36871 - protein, 8 aa, Homo sapiens
  Native (INS_HUMAN)
CTSICSLY

SEQ ID NO: 36872 - protein, 11 aa, Homo sapiens
  Native (INS_HUMAN)
MALWMRLLPLL

SEQ ID NO: 36873 - protein, 8 aa, Homo sapiens
  Native (INS_HUMAN)
CGERGFFY

SEQ ID NO: 36874 - protein, 9 aa, Homo sapiens
  Native (INS_HUMAN)
CSLYQLENY

SEQ ID NO: 36875 - protein, 11 aa, Homo sapiens
  Native (INS_HUMAN)
ELGGGPGAGSL

SEQ ID NO: 36876 - protein, 9 aa, Homo sapiens
  Native (INS_HUMAN)
VCGERGFFY

SEQ ID NO: 36877 - protein, 10 aa, Homo sapiens
  Native (INS_HUMAN)
LYLVCGERGF

SEQ ID NO: 36878 - protein, 9 aa, Homo sapiens
  Native (INS_HUMAN)
GPGAGSLQP

SEQ ID NO: 36879 - protein, 8 aa, Homo sapiens
  Native (INS_HUMAN)
ALEGSLQK

SEQ ID NO: 36880 - protein, 8 aa, Homo sapiens
  Native (INS_HUMAN)
GERGFFYT

SEQ ID NO: 36881 - protein, 9 aa, Homo sapiens
  Native (INS_HUMAN)
AGSLQPLAL

SEQ ID NO: 36882 - protein, 8 aa, Homo sapiens
  Native (INS_HUMAN)
QHLCGSHL

SEQ ID NO: 36883 - protein, 10 aa, Homo sapiens
  Native (INS_HUMAN)
GGGPGAGSLQ

SEQ ID NO: 36884 - protein, 11 aa, Homo sapiens
  Native (INS_HUMAN)
ERGFFYTPKTR

SEQ ID NO: 36885 - protein, 9 aa, Homo sapiens
  Native (INS_HUMAN)
ALYLVCGER

SEQ ID NO: 36886 - protein, 10 aa, Homo sapiens
  Native (INS_HUMAN)
ICSLYQLENY

SEQ ID NO: 36887 - protein, 10 aa, Homo sapiens
  Native (INS_HUMAN)
LEGSLQKRGI

SEQ ID NO: 36888 - protein, 11 aa, Homo sapiens
  Native (INS_HUMAN)
HLVEALYLVCG

SEQ ID NO: 36889 - protein, 9 aa, Homo sapiens
  Native (INS_HUMAN)
YTPKTRREA

SEQ ID NO: 36890 - protein, 10 aa, Homo sapiens
  Native (INS_HUMAN)
ALWMRLLPLL

SEQ ID NO: 36891 - protein, 9 aa, Homo sapiens
  Native (INS_HUMAN)
LWMRLLPLL

SEQ ID NO: 36892 - protein, 11 aa, Homo sapiens
  Native (INS_HUMAN)
RGFFYTPKTRR

SEQ ID NO: 36893 - protein, 10 aa, Homo sapiens
  Native (INS_HUMAN)
LVCGERGFFY

SEQ ID NO: 36894 - protein, 11 aa, Homo sapiens
  Native (INS_HUMAN)
LALWGPDPAAA

SEQ ID NO: 36895 - protein, 9 aa, Homo sapiens
  Native (INS_HUMAN)
MALWMRLLP

SEQ ID NO: 36896 - protein, 10 aa, Homo sapiens
  Native (INS_HUMAN)
LALEGSLQKR

SEQ ID NO: 36897 - protein, 8 aa, Homo sapiens
  Native (INS_HUMAN)
VEALYLVC

SEQ ID NO: 36898 - protein, 9 aa, Homo sapiens
  Native (INS_HUMAN)
FVNQHLCGS

SEQ ID NO: 36899 - protein, 11 aa, Homo sapiens
  Native (INS_HUMAN)
VELGGGPGAGS

SEQ ID NO: 36900 - protein, 10 aa, Homo sapiens
  Native (INS_HUMAN)
AEDLQVGQVE

SEQ ID NO: 36901 - protein, 10 aa, Homo sapiens
  Native (INS_HUMAN)
FVNQHLCGSH

SEQ ID NO: 36902 - protein, 9 aa, Homo sapiens
  Native (INS_HUMAN)
LLPLLALLA

SEQ ID NO: 36903 - protein, 11 aa, Homo sapiens
  Native (INS_HUMAN)
SICSLYQLENY

SEQ ID NO: 36904 - protein, 11 aa, Homo sapiens
  Native (INS_HUMAN)
RREAEDLQVGQ

SEQ ID NO: 36905 - protein, 10 aa, Homo sapiens
  Native (INS_HUMAN)
VELGGGPGAG

SEQ ID NO: 36906 - protein, 9 aa, Homo sapiens
  Native (INS_HUMAN)
KTRREAEDL

SEQ ID NO: 36907 - protein, 9 aa, Homo sapiens
  Native (INS_HUMAN)
CCTSICSLY

SEQ ID NO: 36908 - protein, 11 aa, Homo sapiens
  Native (INS_HUMAN)
MRLLPLLALLA

SEQ ID NO: 36909 - protein, 9 aa, Homo sapiens
  Native (INS_HUMAN)
LALWGPDPA

SEQ ID NO: 36910 - protein, 8 aa, Homo sapiens
  Native (INS_HUMAN)
LPLLALLA

SEQ ID NO: 36911 - protein, 10 aa, Homo sapiens
  Native (INS_HUMAN)
GERGFFYTPK

SEQ ID NO: 36912 - protein, 10 aa, Homo sapiens
  Native (INS_HUMAN)
WMRLLPLLAL

SEQ ID NO: 36913 - protein, 10 aa, Homo sapiens
  Native (INS_HUMAN)
VNQHLCGSHL

SEQ ID NO: 36914 - protein, 9 aa, Homo sapiens
  Native (INS_HUMAN)
DLQVGQVEL

SEQ ID NO: 36915 - protein, 9 aa, Homo sapiens
  Native (INS_HUMAN)
GGPGAGSLQ

SEQ ID NO: 36916 - protein, 10 aa, Homo sapiens
  Native (INS_HUMAN)
ALWGPDPAAA

SEQ ID NO: 36917 - protein, 10 aa, Homo sapiens
  Native (INS_HUMAN)
YLVCGERGFF

SEQ ID NO: 36918 - protein, 10 aa, Homo sapiens
  Native (INS_HUMAN)
GFFYTPKTRR

SEQ ID NO: 36919 - protein, 10 aa, Homo sapiens
  Native (INS_HUMAN)
LLPLLALLAL

SEQ ID NO: 36920 - protein, 8 aa, Homo sapiens
  Native (INS_HUMAN)
LVEALYLV

SEQ ID NO: 36921 - protein, 11 aa, Homo sapiens
  Native (INS_HUMAN)
GPGAGSLQPLA

SEQ ID NO: 36922 - protein, 10 aa, Homo sapiens
  Native (INS_HUMAN)
CTSICSLYQL

SEQ ID NO: 36923 - protein, 11 aa, Homo sapiens
  Native (INS_HUMAN)
KTRREAEDLQV

SEQ ID NO: 36924 - protein, 10 aa, Homo sapiens
  Native (INS_HUMAN)
LGGGPGAGSL

SEQ ID NO: 36925 - protein, 9 aa, Homo sapiens
  Native (INS_HUMAN)
CGSHLVEAL

SEQ ID NO: 36926 - protein, 10 aa, Homo sapiens
  Native (INS_HUMAN)
WGPDPAAAFV

SEQ ID NO: 36927 - protein, 11 aa, Homo sapiens
  Native (INS_HUMAN)
ALWMRLLPLLA

SEQ ID NO: 36928 - protein, 10 aa, Homo sapiens
  Native (INS_HUMAN)
LQPLALEGSL

SEQ ID NO: 36929 - protein, 8 aa, Homo sapiens
  Native (INS_HUMAN)
LWMRLLPL

SEQ ID NO: 36930 - protein, 11 aa, Homo sapiens
  Native (INS_HUMAN)
WMRLLPLLALL

SEQ ID NO: 36931 - protein, 10 aa, Homo sapiens
  Native (INS_HUMAN)
NQHLCGSHLV

SEQ ID NO: 36932 - protein, 8 aa, Homo sapiens
  Native (INS_HUMAN)
SHLVEALY

SEQ ID NO: 36933 - protein, 9 aa, Homo sapiens
  Native (INS_HUMAN)
SHLVEALYL

SEQ ID NO: 36934 - protein, 9 aa, Homo sapiens
  Native (INS_HUMAN)
ALWGPDPAA

SEQ ID NO: 36935 - protein, 9 aa, Homo sapiens
  Native (INS_HUMAN)
QPLALEGSL

SEQ ID NO: 36936 - protein, 9 aa, Homo sapiens
  Native (INS_HUMAN)
PLLALLALW

SEQ ID NO: 36937 - protein, 10 aa, Homo sapiens
  Native (INS_HUMAN)
LWMRLLPLLA

SEQ ID NO: 36938 - protein, 11 aa, Homo sapiens
  Native (INS_HUMAN)
LYLVCGERGFF

SEQ ID NO: 36939 - protein, 8 aa, Homo sapiens
  Native (INS_HUMAN)
GGPGAGSL

SEQ ID NO: 36940 - protein, 9 aa, Homo sapiens
  Native (INS_HUMAN)
GPDPAAAFV

SEQ ID NO: 36941 - protein, 9 aa, Homo sapiens
  Native (INS_HUMAN)
REAEDLQVG

SEQ ID NO: 36942 - protein, 11 aa, Homo sapiens
  Native (INS_HUMAN)
GQVELGGGPGA

SEQ ID NO: 36943 - protein, 8 aa, Homo sapiens
  Native (INS_HUMAN)
RLLPLLAL

SEQ ID NO: 36944 - protein, 11 aa, Homo sapiens
  Native (INS_HUMAN)
QHLCGSHLVEA

SEQ ID NO: 36945 - protein, 9 aa, Homo sapiens
  Native (INS_HUMAN)
TSICSLYQL

SEQ ID NO: 36946 - protein, 9 aa, Homo sapiens
  Native (INS_HUMAN)
GGGPGAGSL

SEQ ID NO: 36947 - protein, 8 aa, Homo sapiens
  Native (INS_HUMAN)
FFYTPKTR

SEQ ID NO: 36948 - protein, 8 aa, Artificial Sequence
  Description of Artificial Sequence: Synthetic peptide
  Seed: AAAFVNQH (INS_HUMAN)
  misc_feature (2)..(2): Xaa can be Ala, Ser, Thr, Ile, Gly, Gln, or Val
  misc_feature (8)..(8): Xaa can be Tyr, Phe, Met, Leu, Ile, Val, or His
AXAFVNQX

SEQ ID NO: 36949 - protein, 9 aa, Artificial Sequence
  Description of Artificial Sequence: Synthetic peptide
  Seed: AAAFVNQHL (INS_HUMAN)
  misc_feature (2)..(2): Xaa can be Val, Ala, Ile, Gln, Met, Ser, Arg, Thr, Gly, Leu, Pro, Glu, Asn, Asp, Cys, His, Tyr, Phe, Lys, or Trp
  misc_feature (9)..(9): Xaa can be Tyr, Trp, Phe, Leu, Met, Ile, Val, Lys, Ala, His, Arg, Thr, or Cys
AXAFVNQHX

SEQ ID NO: 36950 - protein, 8 aa, Artificial Sequence
  Description of Artificial Sequence: Synthetic peptide
  Seed: AAFVNQHL (INS_HUMAN)
  misc_feature (2)..(2): Xaa can be Ala, Gln, Thr, Val, Asp, Ile, Gly, Ser, Arg, His, Glu, Asn, Met, Tyr, Leu, Phe, Cys, Pro, or Lys
  misc_feature (8)..(8): Xaa can be Leu, Tyr, Val, Ile, Phe, Met, Lys, Trp, Cys, His, or Ala
AXFVNQHX

SEQ ID NO: 36951 - protein, 9 aa, Artificial Sequence
  Description of Artificial Sequence: Synthetic peptide
  Seed: AAFVNQHLC (INS_HUMAN)
  misc_feature (2)..(2): Xaa can be Ala, Ser, Thr, Gly, Val, Ile, Asn, Gln, Cys, Met, Leu, Pro, Phe, Tyr, Asp, Glu, Trp, His, Lys, or Arg
  misc_feature (9)..(9): Xaa can be Trp, Tyr, Phe, Leu, Met, Ile, Val, Lys, Arg, Cys, Ala, or His
AXFVNQHLX

SEQ ID NO: 36952 - protein, 9 aa, Artificial Sequence
  Description of Artificial Sequence: Synthetic peptide
  Seed: AEDLQVGQV (INS_HUMAN)
  misc_feature (2)..(2): Xaa can be Glu, Ala, Ile, Asp, Thr, Val, Ser, Phe, Gly, Leu, Tyr, Met, Gln, Arg, Cys, His, Trp, Asn, Pro, or Lys
  misc_feature (9)..(9): Xaa can be Leu, Phe, Ile, Met, Val, Tyr, Cys, Ala, Trp, Thr, Pro, Ser, Asp, Arg, Gly, His, or Lys
AXDLQVGQX

SEQ ID NO: 36953 - protein, 10 aa, Artificial Sequence
  Description of Artificial Sequence: Synthetic peptide
  Seed: AEDLQVGQVE (INS_HUMAN)
  misc_feature (2)..(2): Xaa can be Glu, Asp, or Gln
  misc_feature (10)..(10): Xaa can be Ala, Val, Leu, Pro, Met, Cys, Ile, Thr, Phe, His, Arg, Lys, Glu, Asn, Tyr, Asp, Gly, Ser, Gln, or Trp
AXDLQVGQVX

SEQ ID NO: 36954 - protein, 11 aa, Artificial Sequence
  Description of Artificial Sequence: Synthetic peptide
  Seed: AEDLQVGQVEL (INS_HUMAN)
  misc_feature (2)..(2): Xaa can be Glu, Asp, Gln, Leu, Arg, Met, Tyr, Ala, Val, Ile, His, Phe, Trp, Gly, Lys, or Ser
  misc_feature (11)..(11): Xaa can be Leu, Phe, Met, Trp, Ile, Val, Cys, Tyr, Ala, Lys, Ser, Gly, Thr, Gln, His, Arg, Glu, or Pr o
AXDLQVGQVEX

SEQ ID NO: 36955 - protein, 9 aa, Artificial Sequence
  Description of Artificial Sequence: Synthetic peptide
  Seed: AGSLQPLAL (INS_HUMAN)
  misc_feature (2)..(2): Xaa can be Arg, Ala, Pro, Gln, Ser, Thr, Val, Gly, Ile, Leu, Met, Glu, Asn, Asp, Lys, His, Tyr, Cys, Trp, or Phe
  misc_feature (9)..(9): Xaa can be Phe, Val, Ile, Met, Tyr, Leu, Arg, Lys, Trp, His, Ala, Cys, Thr, Pro, Ser, Gln, Gly, Glu, or Asn
AXSLQPLAX

SEQ ID NO: 36956 - protein, 8 aa, Artificial Sequence
  Description of Artificial Sequence: Synthetic peptide
  Seed: ALEGSLQK (INS_HUMAN)
  misc_feature (2)..(2): Xaa can be Ala, Val, Thr, Ser, Leu, Ile, Gln, Asn, Gly, Met, Cys, or Asp
  misc_feature (8)..(8): Xaa can be Tyr, Arg, Lys, or Leu
AXEGSLQX

SEQ ID NO: 36957 - protein, 9 aa, Artificial Sequence
  Description of Artificial Sequence: Synthetic peptide
  Seed: ALEGSLQKR (INS_HUMAN)
  misc_feature (2)..(2): Xaa can be Thr, Ala, Ser, Val, Ile, Met, Gly, Gln, Tyr, Phe, Leu, Trp, Pro, Glu, Asp, Asn, or Cys
  misc_feature (9)..(9): Xaa can be Tyr, Arg, Lys, Phe, Met, Leu, His, Trp, Val, or Ile
AXEGSLQKX

SEQ ID NO: 36958 - protein, 9 aa, Artificial Sequence
  Description of Artificial Sequence: Synthetic peptide
  Seed: ALWGPDPAA (INS_HUMAN)
  misc_feature (2)..(2): Xaa can be Gln, Met, Leu, Ile, Val, Thr, Ala, Glu, Ser, Asn, Gly, Asp, Cys, Phe, His, Tyr, Trp, Lys, or Pro
  misc_feature (9)..(9): Xaa can be Arg, Val, Leu, Ile, Lys, Ala, Met, Tyr, Phe, Thr, Cys, Ser, Trp, His, Pro, or Gly
AXWGPDPAX

SEQ ID NO: 36959 - protein, 10 aa, Artificial Sequence
  Description of Artificial Sequence: Synthetic peptide
  Seed: ALWGPDPAAA (INS_HUMAN)
  misc_feature (2)..(2): Xaa can be Gln, Leu, Met, Ile, Val, Thr, Glu, Ala, Ser, Tyr, Phe, His, Trp, Asp, Asn, Lys, Gly, Cys, Pro, or Arg
  misc_feature (10)..(10): Xaa can be Arg, Lys, Tyr, Val, Leu, Ile, Ala, Met, Phe, Thr, His, Cys, Trp, Ser, Gln, Gly, or Pro
AXWGPDPAAX

SEQ ID NO: 36960 - protein, 11 aa, Artificial Sequence
  Description of Artificial Sequence: Synthetic peptide
  Seed: ALWGPDPAAAF (INS_HUMAN)
  misc_feature (2)..(2): Xaa can be Arg, Ser, Ala, Val, Thr, Gln, Leu, Tyr, Gly, Met, Ile, Glu, His, Pro, Trp, Phe, Cys, Asn, Lys, or Asp
  misc_feature (11)..(11): Xaa can be Trp, Leu, Met, Phe, Tyr, Lys, Arg, His, Val, Ile, Cys, Ala, Gln, Thr, Asn, Ser, Pro, Gly, or Glu
AXWGPDPAAAX

SEQ ID NO: 36961 - protein, 9 aa, Artificial Sequence
  Description of Artificial Sequence: Synthetic peptide
  Seed: ALWMRLLPL (INS_HUMAN)
  misc_feature (2)..(2): Xaa can be Gln, Leu, Met, Pro, Ile, Ser, Thr, Ala, Val, Lys, Asn, Glu, Gly, His, Arg, Phe, Tyr, Asp, Trp, or Cys
  misc_feature (9)..(9): Xaa can be Tyr, Val, Leu, Phe, Met, Ile, Trp, Arg, Ala, Lys, His, Thr, Cys, Ser, Gly, Pro, Gln, Asn, or Glu
AXWMRLLPX

SEQ ID NO: 36962 - protein, 10 aa, Artificial Sequence
  Description of Artificial Sequence: Synthetic peptide
  Seed: ALWMRLLPLL (INS_HUMAN)
  misc_feature (2)..(2): Xaa can be Leu, Met, Gln, Ile, Val, Tyr, Ser, Thr, Ala, Gly, Phe, Arg, Pro, His, Cys, Asp, Glu, Asn, Lys, or Trp
  misc_feature (10)..(10): Xaa can be Trp, Leu, Ile, Met, Phe, Val, Ala, Thr, Cys, Tyr, Ser, Asn, Asp, His, Gln, Glu, Gly, Arg, Lys, or Pro
AXWMRLLPLX

SEQ ID NO: 36963 - protein, 11 aa, Artificial Sequence
  Description of Artificial Sequence: Synthetic peptide
  Seed: ALWMRLLPLLA (INS_HUMAN)
  misc_feature (2)..(2): Xaa can be Leu, Met, Ile, Gln, Val, or Thr
  misc_feature (11)..(11): Xaa can be Val, Ile, His, Lys, Tyr, Glu, Asp, Ala, Gly, Met, Gln, Ser, Trp, Pro, Thr, Leu, Arg, Asn, Phe, or Cys
AXWMRLLPLLX

SEQ ID NO: 36964 - protein, 9 aa, Artificial Sequence
  Description of Artificial Sequence: Synthetic peptide
  Seed: ALYLVCGER (INS_HUMAN)
  misc_feature (2)..(2): Xaa can be Leu, Ser, Ala, Val, Met, Thr, Ile, Asp, Gly, Asn, Pro, Trp, Gln, Cys, Phe, Tyr, Glu, or Hi s
  misc_feature (9)..(9): Xaa can be Arg, Lys, Tyr, or His
AXYLVCGEX

SEQ ID NO: 36965 - protein, 11 aa, Artificial Sequence
  Description of Artificial Sequence: Synthetic peptide
  Seed: ALYLVCGERGF (INS_HUMAN)
  misc_feature (2)..(2): Xaa can be Gln, Ala, Leu, Val, Met, Thr, Ile, Ser, or Glu
  misc_feature (11)..(11): Xaa can be Tyr, Phe, Met, Trp, or Leu
AXYLVCGERGX

SEQ ID NO: 36966 - protein, 9 aa, Artificial Sequence
  Description of Artificial Sequence: Synthetic peptide
  Seed: CCTSICSLY (INS_HUMAN)
  misc_feature (2)..(2): Xaa can be Ile, Thr, Val, Met, Gln, Ala, Leu, Ser, Gly, Asp, Asn, Tyr, Trp, Phe, Pro, Arg, Lys, His, Cys, or Glu
  misc_feature (9)..(9): Xaa can be Tyr, Phe, Lys, Met, Arg, or His
CXTSICSLX

SEQ ID NO: 36967 - protein, 8 aa, Artificial Sequence
  Description of Artificial Sequence: Synthetic peptide
  Seed: CGERGFFY (INS_HUMAN)
  misc_feature (2)..(2): Xaa can be Ser, Ile, Gln, Asp, Met, Ala, Thr, Leu, Val, Gly, Cys, or Asn
  misc_feature (8)..(8): Xaa can be , or Tyr
CXERGFFX

SEQ ID NO: 36968 - protein, 9 aa, Artificial Sequence
  Description of Artificial Sequence: Synthetic peptide
  Seed: CGSHLVEAL (INS_HUMAN)
  misc_feature (2)..(2): Xaa can be Ala, Ser, Ile, Val, Thr, Gly, Gln, Arg, Tyr, Leu, Phe, Glu, Met, Asn, Cys, His, Trp, Pro, Asp, or Lys
  misc_feature (9)..(9): Xaa can be Leu, Tyr, Phe, Met, Lys, Ile, Val, His, Arg, Trp, or Ala
CXSHLVEAX

SEQ ID NO: 36969 - protein, 10 aa, Artificial Sequence
  Description of Artificial Sequence: Synthetic peptide
  Seed: CGSHLVEALY (INS_HUMAN)
  misc_feature (2)..(2): Xaa can be Ser, Val, Met, Ile, Thr, Gln, Asn, Leu, Gly, Ala, Tyr, His, Arg, Lys, Asp, Phe, Glu, Pro, Trp, or Cys
  misc_feature (10)..(10): Xaa can be Tyr, Phe, Trp, Lys, Arg, or Met
CXSHLVEALX

SEQ ID NO: 36970 - protein, 9 aa, Artificial Sequence
  Description of Artificial Sequence: Synthetic peptide
  Seed: CSLYQLENY (INS_HUMAN)
  misc_feature (2)..(2): Xaa can be Thr, Ser, Ala, Gln, Met, Gly, Leu, Pro, Glu, Val, Ile, Cys, Phe, Asn, Tyr, Asp, or Trp
  misc_feature (9)..(9): Xaa can be Trp, Tyr, Phe, Met, Leu, or Ile
CXLYQLENX

SEQ ID NO: 36971 - protein, 8 aa, Artificial Sequence
  Description of Artificial Sequence: Synthetic peptide
  Seed: CTSICSLY (INS_HUMAN)
  misc_feature (2)..(2): Xaa can be Met, Thr, Val, Ala, Gln, Ser, or Ile
  misc_feature (8)..(8): Xaa can be , or Tyr
CXSICSLX

SEQ ID NO: 36972 - protein, 10 aa, Artificial Sequence
  Description of Artificial Sequence: Synthetic peptide
  Seed: CTSICSLYQL (INS_HUMAN)
  misc_feature (2)..(2): Xaa can be Met, Thr, Leu, Val, Ser, Gln, Ile, Phe, Cys, Gly, Ala, Tyr, Glu, Asn, Pro, Asp, Lys, His, Arg, or Trp
  misc_feature (10)..(10): Xaa can be Val, Trp, Leu, Ile, Phe, Ala, Met, or Tyr
CXSICSLYQX

SEQ ID NO: 36973 - protein, 9 aa, Artificial Sequence
  Description of Artificial Sequence: Synthetic peptide
  Seed: DLQVGQVEL (INS_HUMAN)
  misc_feature (2)..(2): Xaa can be Glu, Arg, Gln, His, Ala, Asp, Phe, Tyr, Lys, Leu, Met, Ile, Asn, Trp, Gly, Ser, Thr, Val, Pro, or Cys
  misc_feature (9)..(9): Xaa can be Phe, Tyr, Met, Leu, Ile, Val, Trp, Ala, Cys, Thr, Pro, Ser, or His
DXQVGQVEX

SEQ ID NO: 36974 - protein, 10 aa, Artificial Sequence
  Description of Artificial Sequence: Synthetic peptide
  Seed: EALYLVCGER (INS_HUMAN)
  misc_feature (2)..(2): Xaa can be Thr, Ala, Ile, Val, Tyr, Phe, Cys, Leu, Asn, Ser, Gly, Gln, Met, Trp, Pro, His, Arg, Asp, Glu, or Lys
  misc_feature (10)..(10): Xaa can be Arg, Lys, Tyr, His, or Met
EXLYLVCGEX

SEQ ID NO: 36975 - protein, 8 aa, Artificial Sequence
  Description of Artificial Sequence: Synthetic peptide
  Seed: EDLQVGQV (INS_HUMAN)
  misc_feature (2)..(2): Xaa can be Glu, or Asp
  misc_feature (8)..(8): Xaa can be Leu, Ala, Ile, Val, Cys, Thr, Phe, Met, or Pro
EXLQVGQX

SEQ ID NO: 36976 - protein, 10 aa, Artificial Sequence
  Description of Artificial Sequence: Synthetic peptide
  Seed: EDLQVGQVEL (INS_HUMAN)
  misc_feature (2)..(2): Xaa can be Glu, Gln, or Asp
  misc_feature (10)..(10): Xaa can be Val, Phe, Ile, Met, Ala, Leu, Cys, Tyr, Thr, Pro, Gly, Trp, or Ser
EXLQVGQVEX

SEQ ID NO: 36977 - protein, 11 aa, Artificial Sequence
  Description of Artificial Sequence: Synthetic peptide
  Seed: ELGGGPGAGSL (INS_HUMAN)
  misc_feature (2)..(2): Xaa can be Gly, Ala, Ile, Pro, Leu, Arg, Ser, Met, Asn, Phe, Thr, Gln, Val, Trp, Cys, Glu, Asp, Tyr, His, or Lys
  misc_feature (11)..(11): Xaa can be Tyr, Phe, Glu, Lys, Arg, Met, Asn, Leu, His, Gln, Gly, Trp, Ile, Ser, Asp, Cys, Pro, Val, Ala, or Thr
EXGGGPGAGSX

SEQ ID NO: 36978 - protein, 11 aa, Artificial Sequence
  Description of Artificial Sequence: Synthetic peptide
  Seed: EQCCTSICSLY (INS_HUMAN)
  misc_feature (2)..(2): Xaa can be Met, or Gln
  misc_feature (11)..(11): Xaa can be , or Tyr
EXCCTSICSLX

SEQ ID NO: 36979 - protein, 9 aa, Artificial Sequence
  Description of Artificial Sequence: Synthetic peptide
  Seed: ERGFFYTPK (INS_HUMAN)
  misc_feature (2)..(2): Xaa can be , or Arg
  misc_feature (9)..(9): Xaa can be Lys, Leu, Phe, or Tyr
EXGFFYTPX

SEQ ID NO: 36980 - protein, 11 aa, Artificial Sequence
  Description of Artificial Sequence: Synthetic peptide
  Seed: ERGFFYTPKTR (INS_HUMAN)
  misc_feature (2)..(2): Xaa can be Tyr, Phe, Ile, His, Leu, Met, Cys, Ser, Gln, Asp, Arg, Pro, Ala, Val, Asn, Glu, Lys, Thr, Trp, or Gly
  misc_feature (11)..(11): Xaa can be , or Arg
EXGFFYTPKTX

SEQ ID NO: 36981 - protein, 8 aa, Artificial Sequence
  Description of Artificial Sequence: Synthetic peptide
  Seed: FFYTPKTR (INS_HUMAN)
  misc_feature (2)..(2): Xaa can be , or Phe
  misc_feature (8)..(8): Xaa can be , or Arg
FXYTPKTX

SEQ ID NO: 36982 - protein, 9 aa, Artificial Sequence
  Description of Artificial Sequence: Synthetic peptide
  Seed: FFYTPKTRR (INS_HUMAN)
  misc_feature (2)..(2): Xaa can be Met, Leu, Ile, Thr, Val, Ala, Ser, Gln, Asp, Trp, Asn, Gly, Pro, Tyr, Phe, Glu, Cys, Arg, His, or Lys
  misc_feature (9)..(9): Xaa can be Arg, Lys, Tyr, Leu, Phe, Met, Val, Ile, His, or Ala
FXYTPKTRX

SEQ ID NO: 36983 - protein, 9 aa, Artificial Sequence
  Description of Artificial Sequence: Synthetic peptide
  Seed: FVNQHLCGS (INS_HUMAN)
  misc_feature (2)..(2): Xaa can be Leu, Met, Val, Gln, Ile, Thr, Ser, Ala, Asn, Phe, Gly, Cys, Glu, Asp, or Tyr
  misc_feature (9)..(9): Xaa can be Val, Leu, Ile, Ala, Met, Thr, Ser, Phe, Cys, Pro, or Gly
FXNQHLCGX

SEQ ID NO: 36984 - protein, 10 aa, Artificial Sequence
  Description of Artificial Sequence: Synthetic peptide
  Seed: FVNQHLCGSH (INS_HUMAN)
  misc_feature (2)..(2): Xaa can be Ala, Met, Gly, Ile, Thr, Ser, Val, Gln, Leu, Cys, Asn, Glu, Phe, or Pro
  misc_feature (10)..(10): Xaa can be Tyr, Phe, Met, His, Leu, Val, Ile, Trp, or Ala
FXNQHLCGSX

SEQ ID NO: 36985 - protein, 11 aa, Artificial Sequence
  Description of Artificial Sequence: Synthetic peptide
  Seed: FVNQHLCGSHL (INS_HUMAN)
  misc_feature (2)..(2): Xaa can be Ala, Val, Ser, Ile, Thr, Gly, Leu, Gln, or Met
  misc_feature (11)..(11): Xaa can be Tyr, Phe, Met, Leu, Lys, His, Trp, Ile, or Val
FXNQHLCGSHX

SEQ ID NO: 36986 - protein, 8 aa, Artificial Sequence
  Description of Artificial Sequence: Synthetic peptide
  Seed: GAGSLQPL (INS_HUMAN)
  misc_feature (2)..(2): Xaa can be Ala, or Ser
  misc_feature (8)..(8): Xaa can be Tyr, Leu, or Phe
GXGSLQPX

SEQ ID NO: 36987 - protein, 10 aa, Artificial Sequence
  Description of Artificial Sequence: Synthetic peptide
  Seed: GAGSLQPLAL (INS_HUMAN)
  misc_feature (2)..(2): Xaa can be Ala, Ser, Thr, Val, Gln, Arg, Ile, Met, Glu, Leu, Gly, Asp, Asn, or His
  misc_feature (10)..(10): Xaa can be Arg, Lys, Tyr, Leu, Phe, Met, Ile, Val, His, or Trp
GXGSLQPLAX

SEQ ID NO: 36988 - protein, 8 aa, Artificial Sequence
  Description of Artificial Sequence: Synthetic peptide
  Seed: GERGFFYT (INS_HUMAN)
  misc_feature (2)..(2): Xaa can be , or Glu
  misc_feature (8)..(8): Xaa can be Thr, Ile, Pro, Val, Ala, Cys, Leu, Met, or Phe
GXRGFFYX

SEQ ID NO: 36989 - protein, 9 aa, Artificial Sequence
  Description of Artificial Sequence: Synthetic peptide
  Seed: GERGFFYTP (INS_HUMAN)
  misc_feature (2)..(2): Xaa can be Glu, Asp, or Gln
  misc_feature (9)..(9): Xaa can be Phe, Val, Cys, Leu, Ile, Ala, Met, Thr, Pro, Asp, His, Gly, Ser, Trp, Tyr, Asn, Glu, or Gl n
GXRGFFYTX

SEQ ID NO: 36990 - protein, 10 aa, Artificial Sequence
  Description of Artificial Sequence: Synthetic peptide
  Seed: GERGFFYTPK (INS_HUMAN)
  misc_feature (2)..(2): Xaa can be Arg, Gln, Met, Lys, Trp, Thr, Tyr, His, Ala, Phe, Val, Pro, Glu, Cys, Asn, Asp, Ser, Leu, Ile, or Gly
  misc_feature (10)..(10): Xaa can be Phe, Lys, Leu, Arg, Met, Trp, Tyr, Ile, Val, Ala, or His
GXRGFFYTPX

SEQ ID NO: 36991 - protein, 9 aa, Artificial Sequence
  Description of Artificial Sequence: Synthetic peptide
  Seed: GFFYTPKTR (INS_HUMAN)
  misc_feature (2)..(2): Xaa can be Met, Leu, Val, Thr, Ile, Gln, Ser, Tyr, Phe, Trp, Ala, Gly, Asn, or Pro
  misc_feature (9)..(9): Xaa can be Arg, Lys, Tyr, Leu, or Met
GXFYTPKTX

SEQ ID NO: 36992 - protein, 10 aa, Artificial Sequence
  Description of Artificial Sequence: Synthetic peptide
  Seed: GFFYTPKTRR (INS_HUMAN)
  misc_feature (2)..(2): Xaa can be Thr, Leu, Val, Ile, Met, Phe, Arg, Gln, Trp, Ser, Tyr, Ala, Lys, Glu, Pro, Gly, Asp, Cys, His, or Asn
  misc_feature (10)..(10): Xaa can be Arg, Lys, or Tyr
GXFYTPKTRX

SEQ ID NO: 36993 - protein, 9 aa, Artificial Sequence
  Description of Artificial Sequence: Synthetic peptide
  Seed: GGGPGAGSL (INS_HUMAN)
  misc_feature (2)..(2): Xaa can be Ala, Arg, Gly, Val, Ser, Thr, Gln, Met, Ile, Tyr, Phe, Leu, His, Lys, Glu, Asn, Pro, Cys, Trp, or Asp
  misc_feature (9)..(9): Xaa can be Lys, Tyr, Leu, Met, Phe, Arg, Ile, Val, His, Trp, Ala, Glu, Gln, Asn, Cys, Thr, or Gly
GXGPGAGSX

SEQ ID NO: 36994 - protein, 10 aa, Artificial Sequence
  Description of Artificial Sequence: Synthetic peptide
  Seed: GGGPGAGSLQ (INS_HUMAN)
  misc_feature (2)..(2): Xaa can be Arg, Gly, Ala, Pro, Asn, Gln, Ile, Val, Met, Leu, Ser, Lys, His, Thr, Glu, Phe, Asp, or Cy s
  misc_feature (10)..(10): Xaa can be Lys, Arg, Phe, Tyr, Leu, Asn, His, Glu, Gln, Met, Gly, Ser, Ile, Asp, Thr, Cys, Ala, Trp, or Val
GXGPGAGSLX

SEQ ID NO: 36995 - protein, 11 aa, Artificial Sequence
  Description of Artificial Sequence: Synthetic peptide
  Seed: GGGPGAGSLQP (INS_HUMAN)
  misc_feature (2)..(2): Xaa can be Gly, Arg, Gln, Ala, Asn, Pro, Val, Ile, Ser, Leu, Met, Thr, Asp, Glu, Lys, Cys, His, Phe, Trp, or Tyr
  misc_feature (11)..(11): Xaa can be Lys, Phe, Arg, Asn, Tyr, Leu, Glu, His, Gln, Met, Trp, Gly, Ile, Thr, Ser, Val, Cys, Pro, Ala, or Asp
GXGPGAGSLQX

SEQ ID NO: 36996 - protein, 8 aa, Artificial Sequence
  Description of Artificial Sequence: Synthetic peptide
  Seed: GGPGAGSL (INS_HUMAN)
  misc_feature (2)..(2): Xaa can be Ala, Ile, Met, Thr, Leu, Phe, Gly, Val, or Ser
  misc_feature (8)..(8): Xaa can be Leu, Met, Phe, or Ile
GXPGAGSX

SEQ ID NO: 36997 - protein, 9 aa, Artificial Sequence
  Description of Artificial Sequence: Synthetic peptide
  Seed: GGPGAGSLQ (INS_HUMAN)
  misc_feature (2)..(2): Xaa can be Arg, Gly, Ala, Gln, Pro, or Lys
  misc_feature (9)..(9): Xaa can be Lys, Arg, Leu, His, Phe, Gln, Ile, Glu, Met, Val, Asn, Tyr, or Trp
GXPGAGSLX

SEQ ID NO: 36998 - protein, 11 aa, Artificial Sequence
  Description of Artificial Sequence: Synthetic peptide
  Seed: GGPGAGSLQPL (INS_HUMAN)
  misc_feature (2)..(2): Xaa can be Ala, Gly, Arg, Ser, Val, Thr, Pro, Ile, Asn, Met, Cys, Gln, Leu, His, Phe, Tyr, Lys, Glu, Asp, or Trp
  misc_feature (11)..(11): Xaa can be Leu, Lys, Tyr, Phe, Arg, Met, His, Asn, Ile, Trp, Glu, Gln, Val, Cys, Ala, Asp, Ser, or Gl y
GXPGAGSLQPX

SEQ ID NO: 36999 - protein, 10 aa, Artificial Sequence
  Description of Artificial Sequence: Synthetic peptide
  Seed: GIVEQCCTSI (INS_HUMAN)
  misc_feature (2)..(2): Xaa can be Leu, Met, Gln, Val, Ile, Thr, Ala, or Ser
  misc_feature (10)..(10): Xaa can be Val, Leu, Ala, Ile, Met, or Thr
GXVEQCCTSX

SEQ ID NO: 37000 - protein, 8 aa, Artificial Sequence
  Description of Artificial Sequence: Synthetic peptide
  Seed: GPDPAAAF (INS_HUMAN)
  misc_feature (2)..(2): Xaa can be Ala, Ser, Pro, Thr, Ile, Val, Trp, Phe, Met, Gly, Asn, Gln, Cys, Leu, Tyr, Asp, His, or Gl u
  misc_feature (8)..(8): Xaa can be Leu, Phe, Ile, Met, Val, Tyr, Trp, or Cys
GXDPAAAX

SEQ ID NO: 37001 - protein, 9 aa, Artificial Sequence
  Description of Artificial Sequence: Synthetic peptide
  Seed: GPDPAAAFV (INS_HUMAN)
  misc_feature (2)..(2): Xaa can be Ala, Tyr, Phe, Ile, Thr, Ser, Val, Trp, Pro, Leu, Met, Gly, Cys, Gln, Glu, Asp, His, Asn, Arg, or Lys
  misc_feature (9)..(9): Xaa can be Met, Leu, Phe, Ile, Val, Cys, Ala, Tyr, Trp, Thr, Ser, Pro, Gln, or Lys
GXDPAAAFX

SEQ ID NO: 37002 - protein, 9 aa, Artificial Sequence
  Description of Artificial Sequence: Synthetic peptide
  Seed: GPGAGSLQP (INS_HUMAN)
  misc_feature (2)..(2): Xaa can be , or Pro
  misc_feature (9)..(9): Xaa can be Ser, Pro, Leu, Ala, Met, Val, Phe, Ile, Thr, Gly, or Cys
GXGAGSLQX

SEQ ID NO: 37003 - protein, 10 aa, Artificial Sequence
  Description of Artificial Sequence: Synthetic peptide
  Seed: GPGAGSLQPL (INS_HUMAN)
  misc_feature (2)..(2): Xaa can be , or Pro
  misc_feature (10)..(10): Xaa can be Val, Ile, Thr, Leu, Met, Phe, Pro, Ala, Ser, Cys, Gly, or Tyr
GXGAGSLQPX

SEQ ID NO: 37004 - protein, 11 aa, Artificial Sequence
  Description of Artificial Sequence: Synthetic peptide
  Seed: GPGAGSLQPLA (INS_HUMAN)
  misc_feature (2)..(2): Xaa can be , or Pro
  misc_feature (11)..(11): Xaa can be Leu, Met, Phe, Ala, Pro, Ile, Val, or Cys
GXGAGSLQPLX

SEQ ID NO: 37005 - protein, 11 aa, Artificial Sequence
  Description of Artificial Sequence: Synthetic peptide
  Seed: GQVELGGGPGA (INS_HUMAN)
  misc_feature (2)..(2): Xaa can be Glu, Arg, Gln, His, Asp, Met, Leu, Ile, Val, Ala, Lys, or Pro
  misc_feature (11)..(11): Xaa can be Leu, Ile, Val, Met, Ala, Phe, Thr, Trp, Cys, Pro, Ser, Gly, Lys, Arg, Tyr, Glu, Asp, His, Asn, or Gln
GXVELGGGPGX

SEQ ID NO: 37006 - protein, 8 aa, Artificial Sequence
  Description of Artificial Sequence: Synthetic peptide
  Seed: GSHLVEAL (INS_HUMAN)
  misc_feature (2)..(2): Xaa can be Ala, Ser, Gln, Thr, Gly, Val, Glu, Met, Asn, Ile, Leu, His, Asp, or Arg
  misc_feature (8)..(8): Xaa can be Ile, Leu, Val, Tyr, Lys, Phe, Met, or His
GXHLVEAX

SEQ ID NO: 37007 - protein, 9 aa, Artificial Sequence
  Description of Artificial Sequence: Synthetic peptide
  Seed: GSHLVEALY (INS_HUMAN)
  misc_feature (2)..(2): Xaa can be Ala, Ser, Gln, Thr, Met, Val, Lys, Leu, Gly, Ile, Asp, Arg, Asn, Cys, Phe, Glu, Pro, Trp, His, or Tyr
  misc_feature (9)..(9): Xaa can be Tyr, Phe, Trp, Met, Lys, Leu, Arg, Ile, His, or Val
GXHLVEALX

SEQ ID NO: 37008 - protein, 11 aa, Artificial Sequence
  Description of Artificial Sequence: Synthetic peptide
  Seed: GSHLVEALYLV (INS_HUMAN)
  misc_feature (2)..(2): Xaa can be Trp, Asp, Met, Ala, Glu, Gln, Ile, Tyr, Val, Phe, His, Thr, Arg, Cys, Pro, Lys, Ser, Asn, Leu, or Gly
  misc_feature (11)..(11): Xaa can be Thr, Val, Ile, Leu, Ala, or Met
GXHLVEALYLX

SEQ ID NO: 37009 - protein, 8 aa, Artificial Sequence
  Description of Artificial Sequence: Synthetic peptide
  Seed: GSLQPLAL (INS_HUMAN)
  misc_feature (2)..(2): Xaa can be Ala, Ser, Gln, Glu, Gly, Thr, Met, Asp, Val, or Ile
  misc_feature (8)..(8): Xaa can be Ile, Lys, Val, Leu, Phe, Tyr, Met, Arg, or Ala
GXLQPLAX

SEQ ID NO: 37010 - protein, 10 aa, Artificial Sequence
  Description of Artificial Sequence: Synthetic peptide
  Seed: HLCGSHLVEA (INS_HUMAN)
  misc_feature (2)..(2): Xaa can be Leu, Met, Thr, Val, Ile, Gln, Ala, or Ser
  misc_feature (10)..(10): Xaa can be Leu, Val, Ile, Met, Ala, Thr, or Phe
HXCGSHLVEX

SEQ ID NO: 37011 - protein, 11 aa, Artificial Sequence
  Description of Artificial Sequence: Synthetic peptide
  Seed: HLCGSHLVEAL (INS_HUMAN)
  misc_feature (2)..(2): Xaa can be Ala, Val, Ser, Met, Ile, Thr, Gln, Leu, Gly, Glu, Arg, Pro, Asn, Phe, His, Tyr, Trp, Asp, Cys, or Lys
  misc_feature (11)..(11): Xaa can be Phe, Tyr, Leu, Met, Lys, Trp, Ile, His, Val, Arg, or Ala
HXCGSHLVEAX

SEQ ID NO: 37012 - protein, 8 aa, Artificial Sequence
  Description of Artificial Sequence: Synthetic peptide
  Seed: HLVEALYL (INS_HUMAN)
  misc_feature (2)..(2): Xaa can be Gln, Ala, Thr, Ser, Glu, Gly, Asn, Leu, Asp, Val, Met, or Ile
  misc_feature (8)..(8): Xaa can be Leu, Ile, Val, Met, Phe, Cys, or Ala
HXVEALYX

SEQ ID NO: 37013 - protein, 9 aa, Artificial Sequence
  Description of Artificial Sequence: Synthetic peptide
  Seed: HLVEALYLV (INS_HUMAN)
  misc_feature (2)..(2): Xaa can be Leu, Thr, Met, Gln, Val, Ile, Ala, Ser, Asn, Glu, Gly, Phe, Cys, Asp, His, Arg, Lys, Pro, Trp, or Tyr
  misc_feature (9)..(9): Xaa can be Val, Ile, Leu, Arg, Lys, Phe, Trp, Met, Tyr, Ala, Thr, Ser, Cys, His, Pro, or Gly
HXVEALYLX

SEQ ID NO: 37014 - protein, 10 aa, Artificial Sequence
  Description of Artificial Sequence: Synthetic peptide
  Seed: HLVEALYLVC (INS_HUMAN)
  misc_feature (2)..(2): Xaa can be Ile, Met, Thr, Leu, Val, Gln, Ala, or Ser
  misc_feature (10)..(10): Xaa can be Leu, Ala, Val, Ile, Arg, Cys, Gln, Asp, Met, Asn, Tyr, Ser, Phe, Thr, His, Glu, Trp, Pro, Lys, or Gly
HXVEALYLVX

SEQ ID NO: 37015 - protein, 11 aa, Artificial Sequence
  Description of Artificial Sequence: Synthetic peptide
  Seed: HLVEALYLVCG (INS_HUMAN)
  misc_feature (2)..(2): Xaa can be Met, Leu, Val, Gln, or Ile
  misc_feature (11)..(11): Xaa can be Val, Gln, Asp, His, Met, Pro, Ala, Ser, Trp, Arg, Cys, Leu, Phe, Ile, Glu, Asn, Tyr, Gly, Thr, or Lys
HXVEALYLVCX

SEQ ID NO: 37016 - protein, 10 aa, Artificial Sequence
  Description of Artificial Sequence: Synthetic peptide
  Seed: ICSLYQLENY (INS_HUMAN)
  misc_feature (2)..(2): Xaa can be Thr, Ser, Ala, Tyr, Asn, Ile, Cys, Glu, Gln, Leu, Asp, Arg, Lys, Val, Trp, Pro, Phe, Gly, His, or Met
  misc_feature (10)..(10): Xaa can be Tyr, Trp, Phe, Met, Leu, or Ile
IXSLYQLENX

SEQ ID NO: 37017 - protein, 9 aa, Artificial Sequence
  Description of Artificial Sequence: Synthetic peptide
  Seed: IVEQCCTSI (INS_HUMAN)
  misc_feature (2)..(2): Xaa can be Leu, Ala, Val, Gly, Ser, Phe, Met, Thr, Ile, Cys, Tyr, Gln, Asn, Trp, Asp, or Pro
  misc_feature (9)..(9): Xaa can be Leu, Met, Phe, Ile, Val, Tyr, or Ala
IXEQCCTSX

SEQ ID NO: 37018 - protein, 9 aa, Artificial Sequence
  Description of Artificial Sequence: Synthetic peptide
  Seed: KTRREAEDL (INS_HUMAN)
  misc_feature (2)..(2): Xaa can be Thr, Ser, Arg, Val, Ala, Leu, Ile, Gln, Gly, Met, Glu, Phe, or Tyr
  misc_feature (9)..(9): Xaa can be Lys, Leu, Trp, Phe, Val, Ala, Tyr, Ile, Met, or Arg
KXRREAEDX

SEQ ID NO: 37019 - protein, 11 aa, Artificial Sequence
  Description of Artificial Sequence: Synthetic peptide
  Seed: KTRREAEDLQV (INS_HUMAN)
  misc_feature (2)..(2): Xaa can be Thr, Ser, Ala, Val, Ile, Met, Cys, Gly, Leu, Asn, Gln, Phe, Tyr, Asp, or Pro
  misc_feature (11)..(11): Xaa can be Trp, Phe, Lys, Leu, Ala, Tyr, Met, Val, or Ile
KXRREAEDLQX

SEQ ID NO: 37020 - protein, 9 aa, Artificial Sequence
  Description of Artificial Sequence: Synthetic peptide
  Seed: LALEGSLQK (INS_HUMAN)
  misc_feature (2)..(2): Xaa can be Arg, Ala, Ser, Met, Leu, Val, Thr, Ile, Gly, Gln, Asn, Phe, Cys, Trp, Pro, Tyr, Glu, Asp, or Lys
  misc_feature (9)..(9): Xaa can be Arg, Lys, Tyr, Leu, Met, Phe, Ile, Val, His, Trp, Ala, Gln, Cys, Thr, Glu, or Asn
LXLEGSLQX

SEQ ID NO: 37021 - protein, 10 aa, Artificial Sequence
  Description of Artificial Sequence: Synthetic peptide
  Seed: LALEGSLQKR (INS_HUMAN)
  misc_feature (2)..(2): Xaa can be Met, Leu, Ile, Thr, Val, Gln, Ser, Ala, Pro, Tyr, Phe, Glu, Asn, Asp, Gly, Trp, or His
  misc_feature (10)..(10): Xaa can be Arg, Lys, Tyr, Leu, Met, Phe, Val, Ile, Ala, Trp, or His
LXLEGSLQKX

SEQ ID NO: 37022 - protein, 9 aa, Artificial Sequence
  Description of Artificial Sequence: Synthetic peptide
  Seed: LALWGPDPA (INS_HUMAN)
  misc_feature (2)..(2): Xaa can be Pro, Thr, Ala, Ile, Val, Ser, Leu, Met, Gln, Gly, Asn, Asp, Phe, Glu, or Cys
  misc_feature (9)..(9): Xaa can be Lys, Tyr, Arg, Val, Leu, Met, Ile, Phe, Ala, His, Thr, Cys, Glu, Gly, Pro, Gln, or Ser
LXLWGPDPX

SEQ ID NO: 37023 - protein, 10 aa, Artificial Sequence
  Description of Artificial Sequence: Synthetic peptide
  Seed: LALWGPDPAA (INS_HUMAN)
  misc_feature (2)..(2): Xaa can be Pro, Met, Leu, Asn, Ser, Glu, Cys, Gly, Thr, Val, His, Trp, Lys, Phe, Ala, Gln, Tyr, Ile, Asp, or Arg
  misc_feature (10)..(10): Xaa can be Met, Leu, Ile, Val, Ala, Thr, Gln, Phe, Cys, Arg, Gly, Ser, Tyr, Lys, or Pro
LXLWGPDPAX

SEQ ID NO: 37024 - protein, 11 aa, Artificial Sequence
  Description of Artificial Sequence: Synthetic peptide
  Seed: LALWGPDPAAA (INS_HUMAN)
  misc_feature (2)..(2): Xaa can be Pro, or Ala
  misc_feature (11)..(11): Xaa can be Ala, Pro, Ile, Gln, Phe, Trp, Thr, Lys, Gly, Met, Leu, Cys, Tyr, Arg, Ser, or Val
LXLWGPDPAAX

SEQ ID NO: 37025 - protein, 11 aa, Artificial Sequence
  Description of Artificial Sequence: Synthetic peptide
  Seed: LCGSHLVEALY (INS_HUMAN)
  misc_feature (2)..(2): Xaa can be Asp, Ala, Asn, Tyr, Gly, Ile, Trp, Lys, Arg, Thr, Cys, His, Phe, Leu, Val, Ser, Glu, Met, Gln, or Pro
  misc_feature (11)..(11): Xaa can be Trp, Phe, or Tyr
LXGSHLVEALX

SEQ ID NO: 37026 - protein, 10 aa, Artificial Sequence
  Description of Artificial Sequence: Synthetic peptide
  Seed: LEGSLQKRGI (INS_HUMAN)
  misc_feature (2)..(2): Xaa can be , or Glu
  misc_feature (10)..(10): Xaa can be Ile, Ala, Val, Cys, Leu, Met, or Phe
LXGSLQKRGX

SEQ ID NO: 37027 - protein, 10 aa, Artificial Sequence
  Description of Artificial Sequence: Synthetic peptide
  Seed: LGGGPGAGSL (INS_HUMAN)
  misc_feature (2)..(2): Xaa can be Arg, Gly, Ala, Val, Thr, Ser, Leu, Ile, Gln, Met, Pro, Glu, Asp, Cys, Asn, Phe, His, Trp, Tyr, or Lys
  misc_feature (10)..(10): Xaa can be Phe, Tyr, Lys, Leu, Met, Arg, His, Ile, Val, Trp, Ala, Cys, Gln, Asn, Gly, or Glu
LXGGPGAGSX

SEQ ID NO: 37028 - protein, 11 aa, Artificial Sequence
  Description of Artificial Sequence: Synthetic peptide
  Seed: LGGGPGAGSLQ (INS_HUMAN)
  misc_feature (2)..(2): Xaa can be Gly, Arg, Ala, Pro, Asn, Gln, Val, Ile, Ser, Glu, Asp, Met, Leu, Thr, Cys, His, Lys, Trp, Phe, or Tyr
  misc_feature (11)..(11): Xaa can be Lys, Phe, Leu, Arg, Met, Asn, Glu, Tyr, His, Gln, Ile, Gly, Val, Trp, Ala, Cys, Thr, Asp, Pro, or Ser
LXGGPGAGSLX

SEQ ID NO: 37029 - protein, 8 aa, Artificial Sequence
  Description of Artificial Sequence: Synthetic peptide
  Seed: LLALLALW (INS_HUMAN)
  misc_feature (2)..(2): Xaa can be Met, Asn, Ala, Pro, Gln, Asp, Cys, Ile, Gly, Ser, Leu, Thr, or Val
  misc_feature (8)..(8): Xaa can be , or Trp
LXALLALX

SEQ ID NO: 37030 - protein, 10 aa, Artificial Sequence
  Description of Artificial Sequence: Synthetic peptide
  Seed: LLALWGPDPA (INS_HUMAN)
  misc_feature (2)..(2): Xaa can be Met, Leu, Ile, Gln, Val, Thr, Ala, or Ser
  misc_feature (10)..(10): Xaa can be Val, Leu, Ile, Ala, Met, or Thr
LXALWGPDPX

SEQ ID NO: 37031 - protein, 8 aa, Artificial Sequence
  Description of Artificial Sequence: Synthetic peptide
  Seed: LLPLLALL (INS_HUMAN)
  misc_feature (2)..(2): Xaa can be Leu, Met, Ser, Ala, Ile, Asn, Phe, Trp, Tyr, Val, Asp, or His
  misc_feature (8)..(8): Xaa can be Val, Leu, Ile, or Ala
LXPLLALX

SEQ ID NO: 37032 - protein, 9 aa, Artificial Sequence
  Description of Artificial Sequence: Synthetic peptide
  Seed: LLPLLALLA (INS_HUMAN)
  misc_feature (2)..(2): Xaa can be Leu, Met, Ile, Val, Ala, Gln, Thr, or Ser
  misc_feature (9)..(9): Xaa can be Leu, Val, Ile, Met, or Ala
LXPLLALLX

SEQ ID NO: 37033 - protein, 10 aa, Artificial Sequence
  Description of Artificial Sequence: Synthetic peptide
  Seed: LLPLLALLAL (INS_HUMAN)
  misc_feature (2)..(2): Xaa can be Arg, Lys, Val, Cys, Leu, Ile, Glu, Gln, Thr, Asn, Ser, Asp, Trp, Gly, His, Pro, Met, Phe, Ala, or Tyr
  misc_feature (10)..(10): Xaa can be Met, Leu, Tyr, Ile, Ala, Phe, Val, Lys, or Arg
LXPLLALLAX

SEQ ID NO: 37034 - protein, 8 aa, Artificial Sequence
  Description of Artificial Sequence: Synthetic peptide
  Seed: LPLLALLA (INS_HUMAN)
  misc_feature (2)..(2): Xaa can be , or Pro
  misc_feature (8)..(8): Xaa can be Ala, Met, Leu, Val, or Ile
LXLLALLX

SEQ ID NO: 37035 - protein, 9 aa, Artificial Sequence
  Description of Artificial Sequence: Synthetic peptide
  Seed: LPLLALLAL (INS_HUMAN)
  misc_feature (2)..(2): Xaa can be Pro, His, Arg, Gln, Ala, Gly, Ser, Val, Asp, Thr, Glu, Met, Asn, Leu, Ile, Phe, Cys, Trp, Lys, or Tyr
  misc_feature (9)..(9): Xaa can be Tyr, Phe, Leu, Ile, Met, Val, Trp, Ala, Cys, His, Lys, Ser, Thr, Arg, Pro, Gly, Gln, Glu, or Asn
LXLLALLAX

SEQ ID NO: 37036 - protein, 10 aa, Artificial Sequence
  Description of Artificial Sequence: Synthetic peptide
  Seed: LPLLALLALW (INS_HUMAN)
  misc_feature (2)..(2): Xaa can be Pro, Thr, Ser, Ala, Arg, Asn, Val, His, Leu, Glu, Phe, Trp, Lys, Gln, Met, Ile, Cys, Asp, Gly, or Tyr
  misc_feature (10)..(10): Xaa can be Trp, Phe, Tyr, Leu, Ile, Met, Pro, Glu, Gly, Gln, Asp, Ala, Thr, Val, Asn, Arg, His, Ser, Lys, or Cys
LXLLALLALX

SEQ ID NO: 37037 - protein, 10 aa, Artificial Sequence
  Description of Artificial Sequence: Synthetic peptide
  Seed: LQPLALEGSL (INS_HUMAN)
  misc_feature (2)..(2): Xaa can be Pro, His, Met, Arg, Lys, Gln, Tyr, Ala, Leu, Phe, Glu, Trp, Gly, Cys, Thr, Ile, Asp, Asn, Val, or Ser
  misc_feature (10)..(10): Xaa can be Met, Leu, Tyr, Phe, Val, or Ile
LXPLALEGSX

SEQ ID NO: 37038 - protein, 8 aa, Artificial Sequence
  Description of Artificial Sequence: Synthetic peptide
  Seed: LQVGQVEL (INS_HUMAN)
  misc_feature (2)..(2): Xaa can be Gln, Ala, or Glu
  misc_feature (8)..(8): Xaa can be Val, Ile, Met, or Leu
LXVGQVEX

SEQ ID NO: 37039 - protein, 9 aa, Artificial Sequence
  Description of Artificial Sequence: Synthetic peptide
  Seed: LVCGERGFF (INS_HUMAN)
  misc_feature (2)..(2): Xaa can be Ala, Ser, Thr, Met, Gln, Ile, Gly, Leu, Val, Pro, Phe, Cys, Glu, Asn, Trp, Asp, or Tyr
  misc_feature (9)..(9): Xaa can be Trp, Tyr, Phe, Met, Leu, Ile, His, or Val
LXCGERGFX

SEQ ID NO: 37040 - protein, 10 aa, Artificial Sequence
  Description of Artificial Sequence: Synthetic peptide
  Seed: LVCGERGFFY (INS_HUMAN)
  misc_feature (2)..(2): Xaa can be Ser, Thr, Ala, Val, Met, Ile, Leu, Gly, Phe, Asn, Gln, Trp, Pro, Cys, Tyr, Asp, Glu, or Hi s
  misc_feature (10)..(10): Xaa can be Tyr, Trp, Phe, Lys, Arg, Leu, Ile, Met, or Val
LXCGERGFFX

SEQ ID NO: 37041 - protein, 8 aa, Artificial Sequence
  Description of Artificial Sequence: Synthetic peptide
  Seed: LVEALYLV (INS_HUMAN)
  misc_feature (2)..(2): Xaa can be Met, Trp, Leu, Ala, Phe, Tyr, Ile, Asn, Ser, Gln, Asp, Val, His, Thr, Pro, Gly, or Cys
  misc_feature (8)..(8): Xaa can be Val, Leu, Ile, Ala, Met, or Thr
LXEALYLX

SEQ ID NO: 37042 - protein, 10 aa, Artificial Sequence
  Description of Artificial Sequence: Synthetic peptide
  Seed: LWGPDPAAAF (INS_HUMAN)
  misc_feature (2)..(2): Xaa can be Arg, Met, Tyr, Phe, Trp, Gln, Glu, Leu, Ile, Pro, Val, Ala, Gly, His, Ser, Thr, Asp, Asn, Lys, or Cys
  misc_feature (10)..(10): Xaa can be Phe, Tyr, Leu, Met, Trp, Ile, His, Val, Arg, or Lys
LXGPDPAAAX

SEQ ID NO: 37043 - protein, 8 aa, Artificial Sequence
  Description of Artificial Sequence: Synthetic peptide
  Seed: LWMRLLPL (INS_HUMAN)
  misc_feature (2)..(2): Xaa can be Trp, Tyr, Leu, Phe, Arg, Ala, Pro, Lys, Met, Ile, Val, His, Gln, Asn, Thr, Gly, Ser, Glu, or Cys
  misc_feature (8)..(8): Xaa can be Leu, Met, Ile, Val, Phe, Ala, Tyr, or Trp
LXMRLLPX

SEQ ID NO: 37044 - protein, 9 aa, Artificial Sequence
  Description of Artificial Sequence: Synthetic peptide
  Seed: LWMRLLPLL (INS_HUMAN)
  misc_feature (2)..(2): Xaa can be Arg, Tyr, Gln, Phe, Trp, Asn, Gly, Ala, Leu, Met, Val, Thr, Ile, Ser, Cys, Lys, Glu, His, Pro, or Asp
  misc_feature (9)..(9): Xaa can be Leu, Ile, Tyr, Phe, Met, Trp, Val, Lys, Ala, Cys, Arg, Thr, Gln, His, or Gly
LXMRLLPLX

SEQ ID NO: 37045 - protein, 10 aa, Artificial Sequence
  Description of Artificial Sequence: Synthetic peptide
  Seed: LWMRLLPLLA (INS_HUMAN)
  misc_feature (2)..(2): Xaa can be Met, Leu, Asn, Ile, Pro, Trp, Arg, Lys, Ala, Val, His, Asp, Cys, Thr, Phe, Glu, Gly, Gln, Ser, or Tyr
  misc_feature (10)..(10): Xaa can be Ala, Leu, Val, Ile, Asp, Trp, His, Tyr, Gln, Cys, Pro, Glu, Ser, Thr, Gly, Asn, Phe, Arg, Met, or Lys
LXMRLLPLLX

SEQ ID NO: 37046 - protein, 11 aa, Artificial Sequence
  Description of Artificial Sequence: Synthetic peptide
  Seed: LWMRLLPLLAL (INS_HUMAN)
  misc_feature (2)..(2): Xaa can be Arg, Tyr, Trp, His, Gln, Ser, Phe, Lys, Met, Ala, Gly, Pro, Asp, Thr, Asn, Leu, Ile, Val, Glu, or Cys
  misc_feature (11)..(11): Xaa can be Leu, Met, Ile, Phe, Trp, Val, Cys, Lys, Ala, Thr, or Ser
LXMRLLPLLAX

SEQ ID NO: 37047 - protein, 10 aa, Artificial Sequence
  Description of Artificial Sequence: Synthetic peptide
  Seed: LYLVCGERGF (INS_HUMAN)
  misc_feature (2)..(2): Xaa can be Tyr, Trp, or Phe
  misc_feature (10)..(10): Xaa can be Phe, Trp, Leu, or Ile
LXLVCGERGX

SEQ ID NO: 37048 - protein, 11 aa, Artificial Sequence
  Description of Artificial Sequence: Synthetic peptide
  Seed: LYLVCGERGFF (INS_HUMAN)
  misc_feature (2)..(2): Xaa can be Tyr, Phe, or Trp
  misc_feature (11)..(11): Xaa can be Phe, Leu, or Trp
LXLVCGERGFX

SEQ ID NO: 37049 - protein, 8 aa, Artificial Sequence
  Description of Artificial Sequence: Synthetic peptide
  Seed: MALWMRLL (INS_HUMAN)
  misc_feature (2)..(2): Xaa can be Ser, or Ala
  misc_feature (8)..(8): Xaa can be Tyr, Met, Phe, or Leu
MXLWMRLX

SEQ ID NO: 37050 - protein, 9 aa, Artificial Sequence
  Description of Artificial Sequence: Synthetic peptide
  Seed: MALWMRLLP (INS_HUMAN)
  misc_feature (2)..(2): Xaa can be Pro, Ala, Ile, Val, Thr, Ser, Gly, or Met
  misc_feature (9)..(9): Xaa can be Ala, Pro, Ser, Ile, Thr, Val, Asp, Asn, Glu, Gly, Cys, Met, Lys, Leu, Tyr, Phe, or Gln
MXLWMRLLX

SEQ ID NO: 37051 - protein, 10 aa, Artificial Sequence
  Description of Artificial Sequence: Synthetic peptide
  Seed: MALWMRLLPL (INS_HUMAN)
  misc_feature (2)..(2): Xaa can be Pro, Met, Gln, Ser, Leu, Lys, Ala, His, Glu, Asp, Tyr, Val, Cys, Thr, Gly, Ile, Phe, Asn, Arg, or Trp
  misc_feature (10)..(10): Xaa can be Ser, Phe, Cys, Ala, Ile, Thr, Val, Leu, Met, Tyr, Trp, His, Gly, Pro, Gln, or Glu
MXLWMRLLPX

SEQ ID NO: 37052 - protein, 11 aa, Artificial Sequence
  Description of Artificial Sequence: Synthetic peptide
  Seed: MALWMRLLPLL (INS_HUMAN)
  misc_feature (2)..(2): Xaa can be Leu, Pro, Met, Tyr, Thr, Phe, Ala, Ser, Val, His, Gly, Ile, Gln, Lys, Arg, Trp, Glu, Asn, Cys, or Asp
  misc_feature (11)..(11): Xaa can be Trp, Leu, Phe, Ile, Met, Val, Ala, Tyr, Thr, Asp, Gly, Cys, His, Lys, Pro, Gln, Ser, Asn, Glu, or Arg
MXLWMRLLPLX

SEQ ID NO: 37053 - protein, 8 aa, Artificial Sequence
  Description of Artificial Sequence: Synthetic peptide
  Seed: MRLLPLLA (INS_HUMAN)
  misc_feature (2)..(2): Xaa can be His, or Arg
  misc_feature (8)..(8): Xaa can be Ala, Ile, Met, Cys, Thr, Val, Leu, or Pro
MXLLPLLX

SEQ ID NO: 37054 - protein, 9 aa, Artificial Sequence
  Description of Artificial Sequence: Synthetic peptide
  Seed: MRLLPLLAL (INS_HUMAN)
  misc_feature (2)..(2): Xaa can be Arg, Gln, Lys, His, Met, Glu, Ala, Tyr, Pro, Asn, Ser, Leu, Gly, Asp, Phe, Val, Cys, Thr, Trp, or Ile
  misc_feature (9)..(9): Xaa can be Leu, Tyr, Met, Ile, Phe, Val, Ala, His, Trp, Thr, Lys, Cys, Arg, Gly, Pro, Ser, Gln, Asn, or Glu
MXLLPLLAX

SEQ ID NO: 37055 - protein, 10 aa, Artificial Sequence
  Description of Artificial Sequence: Synthetic peptide
  Seed: MRLLPLLALL (INS_HUMAN)
  misc_feature (2)..(2): Xaa can be His, Leu, Gln, Met, Arg, Thr, Gly, Ile, Val, Asp, Cys, Phe, Ser, Asn, Ala, Glu, Pro, Lys, Trp, or Tyr
  misc_feature (10)..(10): Xaa can be Val, Thr, Leu, Cys, Gly, Ile, Met, Ala, Ser, Phe, Pro, Asn, His, Asp, Trp, Tyr, Lys, Glu, Arg, or Gln
MXLLPLLALX

SEQ ID NO: 37056 - protein, 11 aa, Artificial Sequence
  Description of Artificial Sequence: Synthetic peptide
  Seed: MRLLPLLALLA (INS_HUMAN)
  misc_feature (2)..(2): Xaa can be Ser, Thr, Cys, His, Pro, Arg, Asp, Met, Ala, Phe, Lys, Leu, Ile, Trp, Gly, Glu, Tyr, Asn, Gln, or Val
  misc_feature (11)..(11): Xaa can be Ile, Ser, Tyr, Leu, Ala, Met, Lys, Thr, Val, Asp, Gly, Cys, Glu, Gln, Arg, Trp, Asn, Pro, His, or Phe
MXLLPLLALLX

SEQ ID NO: 37057 - protein, 9 aa, Artificial Sequence
  Description of Artificial Sequence: Synthetic peptide
  Seed: NQHLCGSHL (INS_HUMAN)
  misc_feature (2)..(2): Xaa can be Arg, His, Glu, Gln, Val, Met, Ala, Leu, Ile, Asp, Tyr, Ser, Pro, Phe, Lys, Thr, Gly, Asn, Trp, or Cys
  misc_feature (9)..(9): Xaa can be Tyr, Phe, Leu, Met, Ile, Val, Trp, Ala, Cys, Thr, Pro, or His
NXHLCGSHX

SEQ ID NO: 37058 - protein, 10 aa, Artificial Sequence
  Description of Artificial Sequence: Synthetic peptide
  Seed: NQHLCGSHLV (INS_HUMAN)
  misc_feature (2)..(2): Xaa can be Gln, Met, or Leu
  misc_feature (10)..(10): Xaa can be , or Val
NXHLCGSHLX

SEQ ID NO: 37059 - protein, 9 aa, Artificial Sequence
  Description of Artificial Sequence: Synthetic peptide
  Seed: PLLALLALW (INS_HUMAN)
  misc_feature (2)..(2): Xaa can be Ser, Thr, Ala, Gly, Gln, Pro, Asp, Ile, Cys, Met, Asn, Leu, or Val
  misc_feature (9)..(9): Xaa can be Trp, Phe, Leu, Tyr, Ile, or Met
PXLALLALX

SEQ ID NO: 37060 - protein, 10 aa, Artificial Sequence
  Description of Artificial Sequence: Synthetic peptide
  Seed: QCCTSICSLY (INS_HUMAN)
  misc_feature (2)..(2): Xaa can be Thr, Met, Ile, Ala, Leu, Ser, Gly, Val, Glu, Gln, Arg, Asp, Tyr, Trp, Phe, Asn, or Cys
  misc_feature (10)..(10): Xaa can be Tyr, Lys, Phe, or Arg
QXCTSICSLX

SEQ ID NO: 37061 - protein, 8 aa, Artificial Sequence
  Description of Artificial Sequence: Synthetic peptide
  Seed: QHLCGSHL (INS_HUMAN)
  misc_feature (2)..(2): Xaa can be His, or Arg
  misc_feature (8)..(8): Xaa can be Leu, Val, Met, Ile, Ala, or Phe
QXLCGSHX

SEQ ID NO: 37062 - protein, 9 aa, Artificial Sequence
  Description of Artificial Sequence: Synthetic peptide
  Seed: QHLCGSHLV (INS_HUMAN)
  misc_feature (2)..(2): Xaa can be His, Arg, Gln, Pro, Lys, Glu, or Asn
  misc_feature (9)..(9): Xaa can be Leu, Ala, Ile, Met, Trp, Val, Phe, Pro, Thr, Cys, Ser, Tyr, or Gly
QXLCGSHLX

SEQ ID NO: 37063 - protein, 11 aa, Artificial Sequence
  Description of Artificial Sequence: Synthetic peptide
  Seed: QHLCGSHLVEA (INS_HUMAN)
  misc_feature (2)..(2): Xaa can be His, or Arg
  misc_feature (11)..(11): Xaa can be Ala, Cys, Leu, Met, Val, or Ile
QXLCGSHLVEX

SEQ ID NO: 37064 - protein, 9 aa, Artificial Sequence
  Description of Artificial Sequence: Synthetic peptide
  Seed: QPLALEGSL (INS_HUMAN)
  misc_feature (2)..(2): Xaa can be Pro, Ala, Val, Ser, Thr, Ile, or Gly
  misc_feature (9)..(9): Xaa can be Trp, Tyr, Phe, Val, Ala, Leu, Ile, Met, Pro, Ser, Gly, Cys, His, or Thr
QXLALEGSX

SEQ ID NO: 37065 - protein, 8 aa, Artificial Sequence
  Description of Artificial Sequence: Synthetic peptide
  Seed: REAEDLQV (INS_HUMAN)
  misc_feature (2)..(2): Xaa can be Glu, or Asp
  misc_feature (8)..(8): Xaa can be Ile, Phe, Leu, Val, Ala, Met, Ser, Cys, Thr, Tyr, Pro, or Gly
RXAEDLQX

SEQ ID NO: 37066 - protein, 9 aa, Artificial Sequence
  Description of Artificial Sequence: Synthetic peptide
  Seed: REAEDLQVG (INS_HUMAN)
  misc_feature (2)..(2): Xaa can be Glu, Asp, Gln, Ala, Met, Leu, Lys, Arg, His, Asn, Gly, Ile, Pro, Ser, Val, or Thr
  misc_feature (9)..(9): Xaa can be Trp, Leu, Val, Ile, Tyr, Thr, Pro, Cys, Ala, Met, Phe, Gly, Ser, His, Glu, Arg, Asp, Lys, Gln, or Asn
RXAEDLQVX

SEQ ID NO: 37067 - protein, 10 aa, Artificial Sequence
  Description of Artificial Sequence: Synthetic peptide
  Seed: REAEDLQVGQ (INS_HUMAN)
  misc_feature (2)..(2): Xaa can be Glu, Asp, Gln, Val, Asn, Ser, Pro, Lys, Met, Leu, Thr, Ala, His, Arg, or Ile
  misc_feature (10)..(10): Xaa can be Trp, Leu, Cys, Val, Phe, Tyr, Ile, Met, Ala, Thr, Asp, Gly, Asn, Pro, Arg, Glu, Gln, His, Lys, or Ser
RXAEDLQVGX

SEQ ID NO: 37068 - protein, 11 aa, Artificial Sequence
  Description of Artificial Sequence: Synthetic peptide
  Seed: REAEDLQVGQV (INS_HUMAN)
  misc_feature (2)..(2): Xaa can be Glu, Gln, Met, Leu, Asp, Ile, Val, Ala, Thr, Ser, Asn, His, Lys, Phe, Gly, Arg, Cys, Tyr, Trp, or Pro
  misc_feature (11)..(11): Xaa can be Trp, Phe, Leu, Ile, Met, Val, Tyr, Cys, Ala, Thr, His, Gly, Ser, Pro, Gln, Glu, Lys, or Ar g
RXAEDLQVGQX

SEQ ID NO: 37069 - protein, 8 aa, Artificial Sequence
  Description of Artificial Sequence: Synthetic peptide
  Seed: RGFFYTPK (INS_HUMAN)
  misc_feature (2)..(2): Xaa can be Thr, Ser, Val, Met, Arg, Trp, Gly, Phe, Leu, Ala, His, Gln, Lys, Tyr, Ile, Asn, Pro, Cys, Asp, or Glu
  misc_feature (8)..(8): Xaa can be Arg, Lys, Tyr, Ala, Val, Ile, Leu, Met, Phe, Pro, Gly, Ser, or His
RXFFYTPX

SEQ ID NO: 37070 - protein, 10 aa, Artificial Sequence
  Description of Artificial Sequence: Synthetic peptide
  Seed: RGFFYTPKTR (INS_HUMAN)
  misc_feature (2)..(2): Xaa can be Thr, Ser, Met, Val, Tyr, Leu, Ile, Ala, Phe, Trp, Gln, Gly, Asn, Asp, Arg, Pro, Glu, Cys, His, or Lys
  misc_feature (10)..(10): Xaa can be Lys, Arg, Ala, Val, Leu, Ile, Met, Tyr, Ser, Gly, His, Phe, Thr, Cys, or Pro
RXFFYTPKTX

SEQ ID NO: 37071 - protein, 11 aa, Artificial Sequence
  Description of Artificial Sequence: Synthetic peptide
  Seed: RGFFYTPKTRR (INS_HUMAN)
  misc_feature (2)..(2): Xaa can be Ile, Gln, Trp, Val, Ala, Ser, Tyr, Leu, Thr, Met, Phe, Gly, Lys, Cys, Asn, Pro, His, Arg, Asp, or Glu
  misc_feature (11)..(11): Xaa can be Arg, Lys, His, Thr, Val, Ser, Met, Gln, Ile, Phe, Trp, Pro, Gly, Ala, Asn, Asp, Leu, Tyr, Glu, or Cys
RXFFYTPKTRX

SEQ ID NO: 37072 - protein, 8 aa, Artificial Sequence
  Description of Artificial Sequence: Synthetic peptide
  Seed: RLLPLLAL (INS_HUMAN)
  misc_feature (2)..(2): Xaa can be Gln, Glu, Leu, Gly, Pro, Ser, Ala, Met, Asn, Val, Asp, Thr, or Ile
  misc_feature (8)..(8): Xaa can be Val, Ile, Leu, Met, Ala, Phe, or Cys
RXLPLLAX

SEQ ID NO: 37073 - protein, 9 aa, Artificial Sequence
  Description of Artificial Sequence: Synthetic peptide
  Seed: RLLPLLALL (INS_HUMAN)
  misc_feature (2)..(2): Xaa can be Arg, Leu, Tyr, Thr, Met, Gln, Ser, Val, Ile, Trp, Ala, Glu, Phe, Lys, Gly, Asn, His, Asp, Pro, or Cys
  misc_feature (9)..(9): Xaa can be Val, Trp, Tyr, Met, Arg, Ile, Leu, Phe, Lys, His, Cys, Ala, Thr, Gly, Ser, Pro, Gln, Asn, Asp, or Glu
RXLPLLALX

SEQ ID NO: 37074 - protein, 10 aa, Artificial Sequence
  Description of Artificial Sequence: Synthetic peptide
  Seed: RLLPLLALLA (INS_HUMAN)
  misc_feature (2)..(2): Xaa can be Val, Gln, Ile, Met, Leu, Thr, Phe, Tyr, Ser, Ala, Lys, Gly, Arg, Glu, Asn, Cys, Pro, Trp, Asp, or His
  misc_feature (10)..(10): Xaa can be Leu, Val, Ile, Ala, Met, Pro, Gly, Ser, Cys, Phe, Thr, Gln, Lys, His, Trp, Arg, Glu, Tyr, Asp, or Asn
RXLPLLALLX

SEQ ID NO: 37075 - protein, 11 aa, Artificial Sequence
  Description of Artificial Sequence: Synthetic peptide
  Seed: RLLPLLALLAL (INS_HUMAN)
  misc_feature (2)..(2): Xaa can be Leu, Met, Thr, Ile, Gln, Val, Ala, Ser, Pro, Asn, Gly, Glu, Tyr, Phe, Lys, Cys, Asp, Trp, Arg, or His
  misc_feature (11)..(11): Xaa can be Met, Ile, Val, Leu, Trp, Phe, Tyr, Ala, Glu, Gln, His, Arg, Cys, Asp, Pro, Lys, Asn, Ser, Gly, or Thr
RXLPLLALLAX

SEQ ID NO: 37076 - protein, 9 aa, Artificial Sequence
  Description of Artificial Sequence: Synthetic peptide
  Seed: RREAEDLQV (INS_HUMAN)
  misc_feature (2)..(2): Xaa can be Arg, Gln, Ala, His, Phe, Tyr, Ile, Leu, Lys, Asn, Met, Glu, Trp, Val, Gly, Ser, Asp, or Th r
  misc_feature (9)..(9): Xaa can be Leu, Met, Lys, Arg, Phe, Ile, Val, Tyr, Cys, Trp, Gln, His, Glu, Thr, Asn, or Ala
RXEAEDLQX

SEQ ID NO: 37077 - protein, 11 aa, Artificial Sequence
  Description of Artificial Sequence: Synthetic peptide
  Seed: RREAEDLQVGQ (INS_HUMAN)
  misc_feature (2)..(2): Xaa can be Arg, Gln, Met, Lys, Gly, or Ala
  misc_feature (11)..(11): Xaa can be Lys, Phe, Tyr, Arg, Leu, Ala, Met, His, Gln, Ile, Trp, or Val
RXEAEDLQVGX

SEQ ID NO: 37078 - protein, 8 aa, Artificial Sequence
  Description of Artificial Sequence: Synthetic peptide
  Seed: SHLVEALY (INS_HUMAN)
  misc_feature (2)..(2): Xaa can be , or His
  misc_feature (8)..(8): Xaa can be Tyr, or Phe
SXLVEALX

SEQ ID NO: 37079 - protein, 9 aa, Artificial Sequence
  Description of Artificial Sequence: Synthetic peptide
  Seed: SHLVEALYL (INS_HUMAN)
  misc_feature (2)..(2): Xaa can be Arg, His, Gln, Ala, Tyr, Phe, Lys, Ser, Asp, Asn, Gly, Glu, Trp, Met, Ile, Thr, or Val
  misc_feature (9)..(9): Xaa can be Leu, Met, Phe, Tyr, Ile, Val, Ala, Trp, Cys, His, Thr, Pro, Lys, Arg, or Ser
SXLVEALYX

SEQ ID NO: 37080 - protein, 10 aa, Artificial Sequence
  Description of Artificial Sequence: Synthetic peptide
  Seed: SHLVEALYLV (INS_HUMAN)
  misc_feature (2)..(2): Xaa can be Met, Leu, Phe, Gln, Tyr, His, Ala, Asp, Ile, Ser, Glu, Val, Arg, Pro, Cys, Trp, Thr, Gly, Asn, or Lys
  misc_feature (10)..(10): Xaa can be Ser, Cys, Ala, Thr, Ile, Leu, Met, Gly, Val, Phe, Pro, Glu, Tyr, Trp, Arg, Lys, His, Asp, Asn, or Gln
SXLVEALYLX

SEQ ID NO: 37081 - protein, 11 aa, Artificial Sequence
  Description of Artificial Sequence: Synthetic peptide
  Seed: SHLVEALYLVC (INS_HUMAN)
  misc_feature (2)..(2): Xaa can be Ile, Gly, Thr, Phe, Trp, Gln, Lys, Tyr, His, Val, Ala, Cys, Glu, Arg, Ser, Met, Asn, Asp, Pro, or Leu
  misc_feature (11)..(11): Xaa can be Arg, Val, Thr, Lys, His, Met, Tyr, Gln, Cys, Leu, Pro, Ala, Trp, Phe, Ile, Ser, Asp, Glu, Gly, or Asn
SXLVEALYLVX

SEQ ID NO: 37082 - protein, 11 aa, Artificial Sequence
  Description of Artificial Sequence: Synthetic peptide
  Seed: SICSLYQLENY (INS_HUMAN)
  misc_feature (2)..(2): Xaa can be Ala, Val, Thr, Ser, Ile, Gln, Met, Leu, Phe, Trp, or Tyr
  misc_feature (11)..(11): Xaa can be , or Tyr
SXCSLYQLENX

SEQ ID NO: 37083 - protein, 11 aa, Artificial Sequence
  Description of Artificial Sequence: Synthetic peptide
  Seed: SLQPLALEGSL (INS_HUMAN)
  misc_feature (2)..(2): Xaa can be Gln, Met, Leu, Pro, Glu, Ile, Val, Asp, Asn, Thr, Arg, Lys, Gly, Ser, Cys, Phe, His, Trp, Tyr, or Ala
  misc_feature (11)..(11): Xaa can be Met, Leu, Trp, Phe, Ile, Val, or Tyr
SXQPLALEGSX

SEQ ID NO: 37084 - protein, 8 aa, Artificial Sequence
  Description of Artificial Sequence: Synthetic peptide
  Seed: SLYQLENY (INS_HUMAN)
  misc_feature (2)..(2): Xaa can be Gln, Met, Leu, Ile, Pro, Ser, Gly, Asn, Ala, Val, Thr, or Glu
  misc_feature (8)..(8): Xaa can be Tyr, Phe, Met, or Leu
SXYQLENX

SEQ ID NO: 37085 - protein, 9 aa, Artificial Sequence
  Description of Artificial Sequence: Synthetic peptide
  Seed: SLYQLENYC (INS_HUMAN)
  misc_feature (2)..(2): Xaa can be Leu, Met, Ile, Val, Gln, Thr, Ser, Phe, or Ala
  misc_feature (9)..(9): Xaa can be Val, Ile, Leu, Ala, Met, Phe, Ser, Cys, or Thr
SXYQLENYX

SEQ ID NO: 37086 - protein, 8 aa, Artificial Sequence
  Description of Artificial Sequence: Synthetic peptide
  Seed: TPKTRREA (INS_HUMAN)
  misc_feature (2)..(2): Xaa can be Pro, Ala, or Val
  misc_feature (8)..(8): Xaa can be Leu, Ile, Phe, Ala, Met, or Val
TXKTRREX

SEQ ID NO: 37087 - protein, 11 aa, Artificial Sequence
  Description of Artificial Sequence: Synthetic peptide
  Seed: TPKTRREAEDL (INS_HUMAN)
  misc_feature (2)..(2): Xaa can be , or Pro
  misc_feature (11)..(11): Xaa can be Phe, Leu, or Met
TXKTRREAEDX

SEQ ID NO: 37088 - protein, 10 aa, Artificial Sequence
  Description of Artificial Sequence: Synthetic peptide
  Seed: TRREAEDLQV (INS_HUMAN)
  misc_feature (2)..(2): Xaa can be Arg, Gln, Gly, Tyr, Glu, Met, Phe, Leu, Ile, Ala, His, Trp, Lys, Asn, Ser, Asp, or Val
  misc_feature (10)..(10): Xaa can be Lys, Leu, Phe, Tyr, Arg, Met, Glu, His, Trp, Ala, Cys, Ile, Val, or Gln
TXREAEDLQX

SEQ ID NO: 37089 - protein, 9 aa, Artificial Sequence
  Description of Artificial Sequence: Synthetic peptide
  Seed: TSICSLYQL (INS_HUMAN)
  misc_feature (2)..(2): Xaa can be Met, Val, Leu, Thr, Gln, Ile, Ala, Ser, Phe, Arg, Gly, Glu, Asn, Cys, Tyr, Pro, Asp, Trp, Lys, or His
  misc_feature (9)..(9): Xaa can be Trp, Val, Leu, Phe, Ile, Tyr, Met, Thr, Ala, Ser, Cys, Gly, Lys, or Pro
TXICSLYQX

SEQ ID NO: 37090 - protein, 9 aa, Artificial Sequence
  Description of Artificial Sequence: Synthetic peptide
  Seed: VCGERGFFY (INS_HUMAN)
  misc_feature (2)..(2): Xaa can be Ser, Thr, Ala, Ile, Val, Met, Gly, Leu, Asn, Gln, Phe, Tyr, Cys, Trp, Asp, Glu, Arg, Lys, Pro, or His
  misc_feature (9)..(9): Xaa can be Tyr, Phe, Leu, Met, Lys, Arg, Ile, Val, Trp, or His
VXGERGFFX

SEQ ID NO: 37091 - protein, 8 aa, Artificial Sequence
  Description of Artificial Sequence: Synthetic peptide
  Seed: VEALYLVC (INS_HUMAN)
  misc_feature (2)..(2): Xaa can be Glu, or Asp
  misc_feature (8)..(8): Xaa can be Ile, Met, Leu, Ala, Val, Pro, Thr, Phe, or Cys
VXALYLVX

SEQ ID NO: 37092 - protein, 9 aa, Artificial Sequence
  Description of Artificial Sequence: Synthetic peptide
  Seed: VEALYLVCG (INS_HUMAN)
  misc_feature (2)..(2): Xaa can be Glu, or Asp
  misc_feature (9)..(9): Xaa can be Ala, Ile, Val, Leu, Met, Thr, Gly, Pro, Ser, Cys, or Phe
VXALYLVCX

SEQ ID NO: 37093 - protein, 9 aa, Artificial Sequence
  Description of Artificial Sequence: Synthetic peptide
  Seed: VELGGGPGA (INS_HUMAN)
  misc_feature (2)..(2): Xaa can be Glu, Asp, or Gln
  misc_feature (9)..(9): Xaa can be Phe, Ala, Cys, Val, Ile, Leu, Met, Arg, Thr, Lys, Tyr, Pro, Trp, Gly, Ser, Glu, or Asp
VXLGGGPGX

SEQ ID NO: 37094 - protein, 10 aa, Artificial Sequence
  Description of Artificial Sequence: Synthetic peptide
  Seed: VELGGGPGAG (INS_HUMAN)
  misc_feature (2)..(2): Xaa can be Glu, Asp, or Gln
  misc_feature (10)..(10): Xaa can be Ala, Leu, Cys, Ile, Val, Phe, Met, Gly, Trp, Tyr, Thr, Ser, or Pro
VXLGGGPGAX

SEQ ID NO: 37095 - protein, 11 aa, Artificial Sequence
  Description of Artificial Sequence: Synthetic peptide
  Seed: VELGGGPGAGS (INS_HUMAN)
  misc_feature (2)..(2): Xaa can be Glu, Asp, or Gln
  misc_feature (11)..(11): Xaa can be Cys, Leu, Met, Ala, Val, Ile, Phe, Arg, Asp, Thr, Gln, Pro, Tyr, Trp, Ser, Gly, or Lys
VXLGGGPGAGX

SEQ ID NO: 37096 - protein, 8 aa, Artificial Sequence
  Description of Artificial Sequence: Synthetic peptide
  Seed: VEQCCTSI (INS_HUMAN)
  misc_feature (2)..(2): Xaa can be Glu, or Asp
  misc_feature (8)..(8): Xaa can be Met, Leu, Phe, Val, Ile, Ala, or Cys
VXQCCTSX

SEQ ID NO: 37097 - protein, 9 aa, Artificial Sequence
  Description of Artificial Sequence: Synthetic peptide
  Seed: VEQCCTSIC (INS_HUMAN)
  misc_feature (2)..(2): Xaa can be Glu, Asp, or Gln
  misc_feature (9)..(9): Xaa can be Leu, Ala, Cys, Val, Ser, Thr, Phe, Pro, Met, Ile, or Gly
VXQCCTSIX

SEQ ID NO: 37098 - protein, 11 aa, Artificial Sequence
  Description of Artificial Sequence: Synthetic peptide
  Seed: VEQCCTSICSL (INS_HUMAN)
  misc_feature (2)..(2): Xaa can be , or Glu
  misc_feature (11)..(11): Xaa can be Val, Pro, Phe, Ile, Ala, Cys, Leu, or Met
VXQCCTSICSX

SEQ ID NO: 37099 - protein, 10 aa, Artificial Sequence
  Description of Artificial Sequence: Synthetic peptide
  Seed: VNQHLCGSHL (INS_HUMAN)
  misc_feature (2)..(2): Xaa can be Lys, Phe, Gln, Tyr, Met, His, Arg, Cys, Ile, Leu, Thr, Pro, Trp, Asn, Val, Ala, Asp, Gly, Glu, or Ser
  misc_feature (10)..(10): Xaa can be Phe, Tyr, Leu, Met, or Trp
VXQHLCGSHX

SEQ ID NO: 37100 - protein, 9 aa, Artificial Sequence
  Description of Artificial Sequence: Synthetic peptide
  Seed: WGPDPAAAF (INS_HUMAN)
  misc_feature (2)..(2): Xaa can be Ala, Pro, Tyr, Ser, Arg, Ile, Val, Phe, Leu, Gln, Gly, Thr, Met, Trp, Glu, Asn, Cys, His, Lys, or Asp
  misc_feature (9)..(9): Xaa can be Ile, Leu, Tyr, Met, Phe, His, Val, Lys, Trp, Arg, Cys, Ala, Thr, Gln, Ser, Pro, Gly, Glu, or Asn
WXPDPAAAX

SEQ ID NO: 37101 - protein, 10 aa, Artificial Sequence
  Description of Artificial Sequence: Synthetic peptide
  Seed: WGPDPAAAFV (INS_HUMAN)
  misc_feature (2)..(2): Xaa can be Ala, Val, Leu, Met, Ile, Glu, Gly, Asn, Gln, Thr, His, Pro, Cys, Lys, Arg, Tyr, Asp, Phe, Ser, or Trp
  misc_feature (10)..(10): Xaa can be Phe, Met, Ile, Leu, Val, Tyr, Cys, Trp, or Ala
WXPDPAAAFX

SEQ ID NO: 37102 - protein, 8 aa, Artificial Sequence
  Description of Artificial Sequence: Synthetic peptide
  Seed: WMRLLPLL (INS_HUMAN)
  misc_feature (2)..(2): Xaa can be Met, Leu, Pro, or Ala
  misc_feature (8)..(8): Xaa can be Leu, Val, or Met
WXRLLPLX

SEQ ID NO: 37103 - protein, 9 aa, Artificial Sequence
  Description of Artificial Sequence: Synthetic peptide
  Seed: WMRLLPLLA (INS_HUMAN)
  misc_feature (2)..(2): Xaa can be Met, Leu, Ser, Thr, Pro, Val, Ala, Ile, Tyr, Gln, Phe, Asn, or Gly
  misc_feature (9)..(9): Xaa can be Lys, Leu, Val, Ala, Met, Ile, Ser, Phe, or Thr
WXRLLPLLX

SEQ ID NO: 37104 - protein, 10 aa, Artificial Sequence
  Description of Artificial Sequence: Synthetic peptide
  Seed: WMRLLPLLAL (INS_HUMAN)
  misc_feature (2)..(2): Xaa can be Arg, Pro, Lys, Met, Gln, Trp, Ile, Ser, Asn, His, Glu, Thr, Cys, Tyr, Ala, Gly, Leu, Phe, Asp, or Val
  misc_feature (10)..(10): Xaa can be Ala, Leu, Tyr, Met, Lys, His, Arg, Phe, Ile, Val, Thr, Trp, Gly, Ser, Gln, or Cys
WXRLLPLLAX

SEQ ID NO: 37105 - protein, 11 aa, Artificial Sequence
  Description of Artificial Sequence: Synthetic peptide
  Seed: WMRLLPLLALL (INS_HUMAN)
  misc_feature (2)..(2): Xaa can be Arg, Lys, Met, His, Phe, Ser, Tyr, Trp, Gly, Leu, Val, Glu, Pro, Ile, Asn, Ala, Cys, Asp, Gln, or Thr
  misc_feature (11)..(11): Xaa can be Ala, Met, Val, Leu, Ile, Lys, Arg, Phe, Trp, Gly, Gln, Thr, Tyr, Ser, or His
WXRLLPLLALX

SEQ ID NO: 37106 - protein, 9 aa, Artificial Sequence
  Description of Artificial Sequence: Synthetic peptide
  Seed: YLVCGERGF (INS_HUMAN)
  misc_feature (2)..(2): Xaa can be Ala, Gln, Ser, Val, Leu, Ile, Met, Glu, Thr, Lys, Gly, Arg, Pro, His, Asp, Asn, Phe, Tyr, Trp, or Cys
  misc_feature (9)..(9): Xaa can be Tyr, Phe, Met, Leu, Trp, His, Ile, Val, or Ala
YXVCGERGX

SEQ ID NO: 37107 - protein, 10 aa, Artificial Sequence
  Description of Artificial Sequence: Synthetic peptide
  Seed: YLVCGERGFF (INS_HUMAN)
  misc_feature (2)..(2): Xaa can be Gln, Lys, Met, Pro, Val, Ser, Thr, Ile, Ala, Glu, Leu, Arg, His, Gly, or Phe
  misc_feature (10)..(10): Xaa can be Tyr, Phe, Met, Trp, or Leu
YXVCGERGFX

SEQ ID NO: 37108 - protein, 11 aa, Artificial Sequence
  Description of Artificial Sequence: Synthetic peptide
  Seed: YLVCGERGFFY (INS_HUMAN)
  misc_feature (2)..(2): Xaa can be Met, Gln, Tyr, Phe, Ile, Val, Asn, Ser, Thr, Pro, Trp, Glu, His, Gly, Leu, or Ala
  misc_feature (11)..(11): Xaa can be Tyr, Phe, or Met
YXVCGERGFFX

SEQ ID NO: 37109 - protein, 9 aa, Artificial Sequence
  Description of Artificial Sequence: Synthetic peptide
  Seed: YTPKTRREA (INS_HUMAN)
  misc_feature (2)..(2): Xaa can be Ala, Ser, Ile, Val, Gly, Thr, Leu, Met, Gln, Phe, Asn, Tyr, Cys, Pro, Trp, Asp, Glu, His, Arg, or Lys
  misc_feature (9)..(9): Xaa can be Leu, Met, Tyr, Phe, Ile, Val, Trp, His, Cys, Ala, Thr, Ser, Lys, or Gln
YXPKTRREX

SEQ ID NO: 37110 - protein, 9 aa, Artificial Sequence
  Description of Artificial Sequence: Synthetic peptide
  Seed: ALIVFWKYR (KKLC1_HUMAN)
AMIVFWKYK

SEQ ID NO: 37111 - protein, 9 aa, Artificial Sequence
  Description of Artificial Sequence: Synthetic peptide
  Seed: ALIVFWKYR (KKLC1_HUMAN)
ATIVFWKYR

SEQ ID NO: 37112 - protein, 9 aa, Artificial Sequence
  Description of Artificial Sequence: Synthetic peptide
  Seed: FYLLLASSI (KKLC1_HUMAN)
FYLLLASSF

SEQ ID NO: 37113 - protein, 10 aa, Artificial Sequence
  Description of Artificial Sequence: Synthetic peptide
  Seed: FYLLLASSIL (KKLC1_HUMAN)
FYLLLASSIF

SEQ ID NO: 37114 - protein, 9 aa, Artificial Sequence
  Description of Artificial Sequence: Synthetic peptide
  Seed: FYLLLASSI (KKLC1_HUMAN)
FYLLLASSW

SEQ ID NO: 37115 - protein, 10 aa, Artificial Sequence
  Description of Artificial Sequence: Synthetic peptide
  Seed: GEMSSNSTAL (KKLC1_HUMAN)
GEMSSNSTAF

SEQ ID NO: 37116 - protein, 9 aa, Artificial Sequence
  Description of Artificial Sequence: Synthetic peptide
  Seed: GEMSSNSTA (KKLC1_HUMAN)
GEMSSNSTV

SEQ ID NO: 37117 - protein, 9 aa, Artificial Sequence
  Description of Artificial Sequence: Synthetic peptide
  Seed: HTLLSKGFR (KKLC1_HUMAN)
HTLLSKGFK

SEQ ID NO: 37118 - protein, 9 aa, Artificial Sequence
  Description of Artificial Sequence: Synthetic peptide
  Seed: ILNNFPHSI (KKLC1_HUMAN)
IANNFPHSL

SEQ ID NO: 37119 - protein, 9 aa, Artificial Sequence
  Description of Artificial Sequence: Synthetic peptide
  Seed: ILNNFPHSI (KKLC1_HUMAN)
IFNNFPHSL

SEQ ID NO: 37120 - protein, 10 aa, Artificial Sequence
  Description of Artificial Sequence: Synthetic peptide
  Seed: ILCALIVFWK (KKLC1_HUMAN)
IMCALIVFWK

SEQ ID NO: 37121 - protein, 9 aa, Artificial Sequence
  Description of Artificial Sequence: Synthetic peptide
  Seed: IARQKRILV (KKLC1_HUMAN)
IMRQKRILM

SEQ ID NO: 37122 - protein, 9 aa, Artificial Sequence
  Description of Artificial Sequence: Synthetic peptide
  Seed: KLVELEHTL (KKLC1_HUMAN)
KAVELEHTL

SEQ ID NO: 37123 - protein, 9 aa, Artificial Sequence
  Description of Artificial Sequence: Synthetic peptide
  Seed: KLVELEHTL (KKLC1_HUMAN)
KMVELEHTI

SEQ ID NO: 37124 - protein, 9 aa, Artificial Sequence
  Description of Artificial Sequence: Synthetic peptide
  Seed: KLVELEHTL (KKLC1_HUMAN)
KQVELEHTL

SEQ ID NO: 37125 - protein, 9 aa, Artificial Sequence
  Description of Artificial Sequence: Synthetic peptide
  Seed: KLVELEHTL (KKLC1_HUMAN)
KQVELEHTY

SEQ ID NO: 37126 - protein, 9 aa, Artificial Sequence
  Description of Artificial Sequence: Synthetic peptide
  Seed: KLVELEHTL (KKLC1_HUMAN)
KRVELEHTF

SEQ ID NO: 37127 - protein, 9 aa, Artificial Sequence
  Description of Artificial Sequence: Synthetic peptide
  Seed: LASSILCAL (KKLC1_HUMAN)
LASSILCAM

SEQ ID NO: 37128 - protein, 9 aa, Artificial Sequence
  Description of Artificial Sequence: Synthetic peptide
  Seed: LASSILCAL (KKLC1_HUMAN)
LASSILCAV

SEQ ID NO: 37129 - protein, 9 aa, Artificial Sequence
  Description of Artificial Sequence: Synthetic peptide
  Seed: LVRPSSSGL (KKLC1_HUMAN)
LPRPSSSGM

SEQ ID NO: 37130 - protein, 9 aa, Artificial Sequence
  Description of Artificial Sequence: Synthetic peptide
  Seed: LASSILCAL (KKLC1_HUMAN)
LPSSILCAM

SEQ ID NO: 37131 - protein, 9 aa, Artificial Sequence
  Description of Artificial Sequence: Synthetic peptide
  Seed: LSRDILNNF (KKLC1_HUMAN)
LSRDILNNW

SEQ ID NO: 37132 - protein, 9 aa, Artificial Sequence
  Description of Artificial Sequence: Synthetic peptide
  Seed: LVRPSSSGL (KKLC1_HUMAN)
LTRPSSSGL

SEQ ID NO: 37133 - protein, 9 aa, Artificial Sequence
  Description of Artificial Sequence: Synthetic peptide
  Seed: LASSILCAL (KKLC1_HUMAN)
LTSSILCAV

SEQ ID NO: 37134 - protein, 9 aa, Artificial Sequence
  Description of Artificial Sequence: Synthetic peptide
  Seed: MVENKLVEL (KKLC1_HUMAN)
MLENKLVEL

SEQ ID NO: 37135 - protein, 10 aa, Artificial Sequence
  Description of Artificial Sequence: Synthetic peptide
  Seed: NTDNNLAVYD (KKLC1_HUMAN)
NTDNNLAVYY

SEQ ID NO: 37136 - protein, 9 aa, Artificial Sequence
  Description of Artificial Sequence: Synthetic peptide
  Seed: NNFPHSIAR (KKLC1_HUMAN)
NTFPHSIAR

SEQ ID NO: 37137 - protein, 9 aa, Artificial Sequence
  Description of Artificial Sequence: Synthetic peptide
  Seed: RQKRILVNL (KKLC1_HUMAN)
RMKRILVNY

SEQ ID NO: 37138 - protein, 9 aa, Artificial Sequence
  Description of Artificial Sequence: Synthetic peptide
  Seed: SSNSTALAL (KKLC1_HUMAN)
SANSTALAM

SEQ ID NO: 37139 - protein, 10 aa, Artificial Sequence
  Description of Artificial Sequence: Synthetic peptide
  Seed: SNTDNNLAVY (KKLC1_HUMAN)
SLTDNNLAVY

SEQ ID NO: 37140 - protein, 10 aa, Artificial Sequence
  Description of Artificial Sequence: Synthetic peptide
  Seed: SNTDNNLAVY (KKLC1_HUMAN)
SYTDNNLAVY

SEQ ID NO: 37141 - protein, 9 aa, Artificial Sequence
  Description of Artificial Sequence: Synthetic peptide
  Seed: VYDLSRDIL (KKLC1_HUMAN)
VADLSRDIL

SEQ ID NO: 37142 - protein, 10 aa, Artificial Sequence
  Description of Artificial Sequence: Synthetic peptide
  Seed: VELEHTLLSK (KKLC1_HUMAN)
VMLEHTLLSK

SEQ ID NO: 37143 - protein, 10 aa, Artificial Sequence
  Description of Artificial Sequence: Synthetic peptide
  Seed: VELEHTLLSK (KKLC1_HUMAN)
VTLEHTLLSK

SEQ ID NO: 37144 - protein, 9 aa, Artificial Sequence
  Description of Artificial Sequence: Synthetic peptide
  Seed: YLLLASSIL (KKLC1_HUMAN)
YALLASSIM

SEQ ID NO: 37145 - protein, 9 aa, Artificial Sequence
  Description of Artificial Sequence: Synthetic peptide
  Seed: YLLLASSIL (KKLC1_HUMAN)
YMLLASSIL

SEQ ID NO: 37146 - protein, 10 aa, Homo sapiens
  Native (KKLC1_HUMAN)
ARQKRILVNL

SEQ ID NO: 37147 - protein, 9 aa, Homo sapiens
  Native (KKLC1_HUMAN)
CALIVFWKY

SEQ ID NO: 37148 - protein, 9 aa, Homo sapiens
  Native (KKLC1_HUMAN)
FWKYRRFQR

SEQ ID NO: 37149 - protein, 9 aa, Homo sapiens
  Native (KKLC1_HUMAN)
FYLLLASSI

SEQ ID NO: 37150 - protein, 9 aa, Homo sapiens
  Native (KKLC1_HUMAN)
GEMSSNSTA

SEQ ID NO: 37151 - protein, 10 aa, Homo sapiens
  Native (KKLC1_HUMAN)
GEMSSNSTAL

SEQ ID NO: 37152 - protein, 9 aa, Homo sapiens
  Native (KKLC1_HUMAN)
HTLLSKGFR

SEQ ID NO: 37153 - protein, 10 aa, Homo sapiens
  Native (KKLC1_HUMAN)
ILCALIVFWK

SEQ ID NO: 37154 - protein, 9 aa, Homo sapiens
  Native (KKLC1_HUMAN)
ILNNFPHSI

SEQ ID NO: 37155 - protein, 10 aa, Homo sapiens
  Native (KKLC1_HUMAN)
KGFRGASPHR

SEQ ID NO: 37156 - protein, 9 aa, Homo sapiens
  Native (KKLC1_HUMAN)
KLVELEHTL

SEQ ID NO: 37157 - protein, 9 aa, Homo sapiens
  Native (KKLC1_HUMAN)
KRILVNLSM

SEQ ID NO: 37158 - protein, 9 aa, Homo sapiens
  Native (KKLC1_HUMAN)
LASSILCAL

SEQ ID NO: 37159 - protein, 9 aa, Homo sapiens
  Native (KKLC1_HUMAN)
LIVFWKYRR

SEQ ID NO: 37160 - protein, 9 aa, Homo sapiens
  Native (KKLC1_HUMAN)
LLSKGFRGA

SEQ ID NO: 37161 - protein, 9 aa, Homo sapiens
  Native (KKLC1_HUMAN)
LSRDILNNF

SEQ ID NO: 37162 - protein, 9 aa, Homo sapiens
  Native (KKLC1_HUMAN)
LVRPSSSGL

SEQ ID NO: 37163 - protein, 9 aa, Homo sapiens
  Native (KKLC1_HUMAN)
MVENKLVEL

SEQ ID NO: 37164 - protein, 9 aa, Homo sapiens
  Native (KKLC1_HUMAN)
NLSMVENKL

SEQ ID NO: 37165 - protein, 9 aa, Homo sapiens
  Native (KKLC1_HUMAN)
NNFPHSIAR

SEQ ID NO: 37166 - protein, 9 aa, Homo sapiens
  Native (KKLC1_HUMAN)
NSTALALVR

SEQ ID NO: 37167 - protein, 9 aa, Homo sapiens
  Native (KKLC1_HUMAN)
NTDNNLAVY

SEQ ID NO: 37168 - protein, 9 aa, Homo sapiens
  Native (KKLC1_HUMAN)
RFQRNTGEM

SEQ ID NO: 37169 - protein, 9 aa, Homo sapiens
  Native (KKLC1_HUMAN)
RQKRILVNL

SEQ ID NO: 37170 - protein, 10 aa, Homo sapiens
  Native (KKLC1_HUMAN)
SMVENKLVEL

SEQ ID NO: 37171 - protein, 11 aa, Homo sapiens
  Native (KKLC1_HUMAN)
SSILCALIVFW

SEQ ID NO: 37172 - protein, 9 aa, Homo sapiens
  Native (KKLC1_HUMAN)
SSNSTALAL

SEQ ID NO: 37173 - protein, 9 aa, Homo sapiens
  Native (KKLC1_HUMAN)
VYDLSRDIL

SEQ ID NO: 37174 - protein, 9 aa, Homo sapiens
  Native (KKLC1_HUMAN)
YLLLASSIL

SEQ ID NO: 37175 - protein, 10 aa, Artificial Sequence
  Description of Artificial Sequence: Synthetic peptide
  Seed: CALIVFWKYR (KKLC1_HUMAN)
CLLIVFWKYR

SEQ ID NO: 37176 - protein, 9 aa, Artificial Sequence
  Description of Artificial Sequence: Synthetic peptide
  Seed: IARQKRILV (KKLC1_HUMAN)
IPRQKRILL

SEQ ID NO: 37177 - protein, 11 aa, Artificial Sequence
  Description of Artificial Sequence: Synthetic peptide
  Seed: RQKRILVNLSM (KKLC1_HUMAN)
RKKRILVNLSY

SEQ ID NO: 37178 - protein, 9 aa, Artificial Sequence
  Description of Artificial Sequence: Synthetic peptide
  Seed: LASSILCAL (KKLC1_HUMAN)
LKSSILCAF

SEQ ID NO: 37179 - protein, 11 aa, Artificial Sequence
  Description of Artificial Sequence: Synthetic peptide
  Seed: RQKRILVNLSM (KKLC1_HUMAN)
RVKRILVNLSR

SEQ ID NO: 37180 - protein, 9 aa, Artificial Sequence
  Description of Artificial Sequence: Synthetic peptide
  Seed: MVENKLVEL (KKLC1_HUMAN)
MIENKLVEY

SEQ ID NO: 37181 - protein, 10 aa, Artificial Sequence
  Description of Artificial Sequence: Synthetic peptide
  Seed: TLLSKGFRGA (KKLC1_HUMAN)
TLLSKGFRGV

SEQ ID NO: 37182 - protein, 9 aa, Artificial Sequence
  Description of Artificial Sequence: Synthetic peptide
  Seed: ASSILCALI (KKLC1_HUMAN)
ASSILCALW

SEQ ID NO: 37183 - protein, 10 aa, Artificial Sequence
  Description of Artificial Sequence: Synthetic peptide
  Seed: ALIVFWKYRR (KKLC1_HUMAN)
AWIVFWKYRR

SEQ ID NO: 37184 - protein, 10 aa, Artificial Sequence
  Description of Artificial Sequence: Synthetic peptide
  Seed: KGFRGASPHR (KKLC1_HUMAN)
KDFRGASPHA

SEQ ID NO: 37185 - protein, 9 aa, Artificial Sequence
  Description of Artificial Sequence: Synthetic peptide
  Seed: YLLLASSIL (KKLC1_HUMAN)
YQLLASSII

SEQ ID NO: 37186 - protein, 9 aa, Artificial Sequence
  Description of Artificial Sequence: Synthetic peptide
  Seed: KLVELEHTL (KKLC1_HUMAN)
KDVELEHTF

SEQ ID NO: 37187 - protein, 10 aa, Artificial Sequence
  Description of Artificial Sequence: Synthetic peptide
  Seed: LASSILCALI (KKLC1_HUMAN)
LMSSILCALC

SEQ ID NO: 37188 - protein, 9 aa, Artificial Sequence
  Description of Artificial Sequence: Synthetic peptide
  Seed: RFQRNTGEM (KKLC1_HUMAN)
RFQRNTGEL

SEQ ID NO: 37189 - protein, 10 aa, Artificial Sequence
  Description of Artificial Sequence: Synthetic peptide
  Seed: ALVRPSSSGL (KKLC1_HUMAN)
ALVRPSSSGV

SEQ ID NO: 37190 - protein, 9 aa, Artificial Sequence
  Description of Artificial Sequence: Synthetic peptide
  Seed: HTLLSKGFR (KKLC1_HUMAN)
HILLSKGFR

SEQ ID NO: 37191 - protein, 9 aa, Artificial Sequence
  Description of Artificial Sequence: Synthetic peptide
  Seed: SILCALIVF (KKLC1_HUMAN)
SRLCALIVY

SEQ ID NO: 37192 - protein, 9 aa, Artificial Sequence
  Description of Artificial Sequence: Synthetic peptide
  Seed: MVENKLVEL (KKLC1_HUMAN)
MAENKLVEI

SEQ ID NO: 37193 - protein, 9 aa, Artificial Sequence
  Description of Artificial Sequence: Synthetic peptide
  Seed: VELEHTLLS (KKLC1_HUMAN)
VDLEHTLLF

SEQ ID NO: 37194 - protein, 9 aa, Artificial Sequence
  Description of Artificial Sequence: Synthetic peptide
  Seed: LLASSILCA (KKLC1_HUMAN)
LMASSILCI

SEQ ID NO: 37195 - protein, 10 aa, Artificial Sequence
  Description of Artificial Sequence: Synthetic peptide
  Seed: QKRILVNLSM (KKLC1_HUMAN)
QSRILVNLSL

SEQ ID NO: 37196 - protein, 10 aa, Artificial Sequence
  Description of Artificial Sequence: Synthetic peptide
  Seed: SILCALIVFW (KKLC1_HUMAN)
SALCALIVFW

SEQ ID NO: 37197 - protein, 10 aa, Artificial Sequence
  Description of Artificial Sequence: Synthetic peptide
  Seed: RRFQRNTGEM (KKLC1_HUMAN)
RVFQRNTGEY

SEQ ID NO: 37198 - protein, 10 aa, Artificial Sequence
  Description of Artificial Sequence: Synthetic peptide
  Seed: VFWKYRRFQR (KKLC1_HUMAN)
VMWKYRRFQK

SEQ ID NO: 37199 - protein, 9 aa, Artificial Sequence
  Description of Artificial Sequence: Synthetic peptide
  Seed: EMSSNSTAL (KKLC1_HUMAN)
EMSSNSTAM

SEQ ID NO: 37200 - protein, 9 aa, Artificial Sequence
  Description of Artificial Sequence: Synthetic peptide
  Seed: SNTDNNLAV (KKLC1_HUMAN)
STTDNNLAL

SEQ ID NO: 37201 - protein, 9 aa, Artificial Sequence
  Description of Artificial Sequence: Synthetic peptide
  Seed: EMSSNSTAL (KKLC1_HUMAN)
ELSSNSTAF

SEQ ID NO: 37202 - protein, 10 aa, Artificial Sequence
  Description of Artificial Sequence: Synthetic peptide
  Seed: RRFQRNTGEM (KKLC1_HUMAN)
RYFQRNTGEF

SEQ ID NO: 37203 - protein, 9 aa, Artificial Sequence
  Description of Artificial Sequence: Synthetic peptide
  Seed: MVENKLVEL (KKLC1_HUMAN)
MMENKLVEV

SEQ ID NO: 37204 - protein, 9 aa, Artificial Sequence
  Description of Artificial Sequence: Synthetic peptide
  Seed: RILVNLSMV (KKLC1_HUMAN)
RALVNLSMK

SEQ ID NO: 37205 - protein, 9 aa, Artificial Sequence
  Description of Artificial Sequence: Synthetic peptide
  Seed: ILNNFPHSI (KKLC1_HUMAN)
IVNNFPHSK

SEQ ID NO: 37206 - protein, 10 aa, Artificial Sequence
  Description of Artificial Sequence: Synthetic peptide
  Seed: YLLLASSILC (KKLC1_HUMAN)
YVLLASSILM

SEQ ID NO: 37207 - protein, 9 aa, Artificial Sequence
  Description of Artificial Sequence: Synthetic peptide
  Seed: LASSILCAL (KKLC1_HUMAN)
LPSSILCAL

SEQ ID NO: 37208 - protein, 9 aa, Artificial Sequence
  Description of Artificial Sequence: Synthetic peptide
  Seed: GASPHRKST (KKLC1_HUMAN)
GVSPHRKSF

SEQ ID NO: 37209 - protein, 10 aa, Artificial Sequence
  Description of Artificial Sequence: Synthetic peptide
  Seed: NFYLLLASSI (KKLC1_HUMAN)
NQYLLLASSF

SEQ ID NO: 37210 - protein, 8 aa, Artificial Sequence
  Description of Artificial Sequence: Synthetic peptide
  Seed: VYDLSRDI (KKLC1_HUMAN)
VIDLSRDF

SEQ ID NO: 37211 - protein, 9 aa, Artificial Sequence
  Description of Artificial Sequence: Synthetic peptide
  Seed: NNFPHSIAR (KKLC1_HUMAN)
NTFPHSIAI

SEQ ID NO: 37212 - protein, 11 aa, Artificial Sequence
  Description of Artificial Sequence: Synthetic peptide
  Seed: VFWKYRRFQRN (KKLC1_HUMAN)
VSWKYRRFQRR

SEQ ID NO: 37213 - protein, 10 aa, Artificial Sequence
  Description of Artificial Sequence: Synthetic peptide
  Seed: SMVENKLVEL (KKLC1_HUMAN)
SRVENKLVEM

SEQ ID NO: 37214 - protein, 10 aa, Artificial Sequence
  Description of Artificial Sequence: Synthetic peptide
  Seed: YLLLASSILC (KKLC1_HUMAN)
YILLASSILM

SEQ ID NO: 37215 - protein, 10 aa, Artificial Sequence
  Description of Artificial Sequence: Synthetic peptide
  Seed: KLVELEHTLL (KKLC1_HUMAN)
KVVELEHTLL

SEQ ID NO: 37216 - protein, 9 aa, Artificial Sequence
  Description of Artificial Sequence: Synthetic peptide
  Seed: MSSNSTALA (KKLC1_HUMAN)
MTSNSTALY

SEQ ID NO: 37217 - protein, 9 aa, Artificial Sequence
  Description of Artificial Sequence: Synthetic peptide
  Seed: RQKRILVNL (KKLC1_HUMAN)
RAKRILVNR

SEQ ID NO: 37218 - protein, 10 aa, Artificial Sequence
  Description of Artificial Sequence: Synthetic peptide
  Seed: SMVENKLVEL (KKLC1_HUMAN)
SLVENKLVEY

SEQ ID NO: 37219 - protein, 9 aa, Artificial Sequence
  Description of Artificial Sequence: Synthetic peptide
  Seed: ILNNFPHSI (KKLC1_HUMAN)
IANNFPHSF

SEQ ID NO: 37220 - protein, 9 aa, Artificial Sequence
  Description of Artificial Sequence: Synthetic peptide
  Seed: ILCALIVFW (KKLC1_HUMAN)
IACALIVFF

SEQ ID NO: 37221 - protein, 11 aa, Artificial Sequence
  Description of Artificial Sequence: Synthetic peptide
  Seed: LLASSILCALI (KKLC1_HUMAN)
LMASSILCALL

SEQ ID NO: 37222 - protein, 10 aa, Artificial Sequence
  Description of Artificial Sequence: Synthetic peptide
  Seed: QKRILVNLSM (KKLC1_HUMAN)
QERILVNLSI

SEQ ID NO: 37223 - protein, 11 aa, Artificial Sequence
  Description of Artificial Sequence: Synthetic peptide
  Seed: NSNTDNNLAVY (KKLC1_HUMAN)
NTNTDNNLAVW

SEQ ID NO: 37224 - protein, 10 aa, Artificial Sequence
  Description of Artificial Sequence: Synthetic peptide
  Seed: LASSILCALI (KKLC1_HUMAN)
LVSSILCALI

SEQ ID NO: 37225 - protein, 9 aa, Artificial Sequence
  Description of Artificial Sequence: Synthetic peptide
  Seed: MVENKLVEL (KKLC1_HUMAN)
MQENKLVEV

SEQ ID NO: 37226 - protein, 9 aa, Artificial Sequence
  Description of Artificial Sequence: Synthetic peptide
  Seed: KLVELEHTL (KKLC1_HUMAN)
KIVELEHTI

SEQ ID NO: 37227 - protein, 9 aa, Artificial Sequence
  Description of Artificial Sequence: Synthetic peptide
  Seed: SSNSTALAL (KKLC1_HUMAN)
SLNSTALAF

SEQ ID NO: 37228 - protein, 9 aa, Artificial Sequence
  Description of Artificial Sequence: Synthetic peptide
  Seed: KLVELEHTL (KKLC1_HUMAN)
KRVELEHTI

SEQ ID NO: 37229 - protein, 10 aa, Artificial Sequence
  Description of Artificial Sequence: Synthetic peptide
  Seed: SSILCALIVF (KKLC1_HUMAN)
SAILCALIVY

SEQ ID NO: 37230 - protein, 10 aa, Artificial Sequence
  Description of Artificial Sequence: Synthetic peptide
  Seed: AVYDLSRDIL (KKLC1_HUMAN)
ATYDLSRDIY

SEQ ID NO: 37231 - protein, 11 aa, Artificial Sequence
  Description of Artificial Sequence: Synthetic peptide
  Seed: YLLLASSILCA (KKLC1_HUMAN)
YLLLASSILCI

SEQ ID NO: 37232 - protein, 11 aa, Artificial Sequence
  Description of Artificial Sequence: Synthetic peptide
  Seed: YLLLASSILCA (KKLC1_HUMAN)
YWLLASSILCV

SEQ ID NO: 37233 - protein, 10 aa, Artificial Sequence
  Description of Artificial Sequence: Synthetic peptide
  Seed: LLLASSILCA (KKLC1_HUMAN)
LLLASSILCL

SEQ ID NO: 37234 - protein, 10 aa, Artificial Sequence
  Description of Artificial Sequence: Synthetic peptide
  Seed: SIARQKRILV (KKLC1_HUMAN)
SFARQKRILK

SEQ ID NO: 37235 - protein, 9 aa, Artificial Sequence
  Description of Artificial Sequence: Synthetic peptide
  Seed: LLASSILCA (KKLC1_HUMAN)
LTASSILCI

SEQ ID NO: 37236 - protein, 9 aa, Artificial Sequence
  Description of Artificial Sequence: Synthetic peptide
  Seed: NTDNNLAVY (KKLC1_HUMAN)
NQDNNLAVM

SEQ ID NO: 37237 - protein, 9 aa, Artificial Sequence
  Description of Artificial Sequence: Synthetic peptide
  Seed: MVENKLVEL (KKLC1_HUMAN)
MTENKLVEM

SEQ ID NO: 37238 - protein, 9 aa, Artificial Sequence
  Description of Artificial Sequence: Synthetic peptide
  Seed: YLLLASSIL (KKLC1_HUMAN)
YELLASSIM

SEQ ID NO: 37239 - protein, 10 aa, Artificial Sequence
  Description of Artificial Sequence: Synthetic peptide
  Seed: GEMSSNSTAL (KKLC1_HUMAN)
GYMSSNSTAY

SEQ ID NO: 37240 - protein, 9 aa, Artificial Sequence
  Description of Artificial Sequence: Synthetic peptide
  Seed: LLLASSILC (KKLC1_HUMAN)
LLLASSILA

SEQ ID NO: 37241 - protein, 10 aa, Artificial Sequence
  Description of Artificial Sequence: Synthetic peptide
  Seed: SNTDNNLAVY (KKLC1_HUMAN)
SFTDNNLAVY

SEQ ID NO: 37242 - protein, 9 aa, Artificial Sequence
  Description of Artificial Sequence: Synthetic peptide
  Seed: LASSILCAL (KKLC1_HUMAN)
LSSSILCAF

SEQ ID NO: 37243 - protein, 9 aa, Artificial Sequence
  Description of Artificial Sequence: Synthetic peptide
  Seed: RILVNLSMV (KKLC1_HUMAN)
RTLVNLSMF

SEQ ID NO: 37244 - protein, 9 aa, Artificial Sequence
  Description of Artificial Sequence: Synthetic peptide
  Seed: KLVELEHTL (KKLC1_HUMAN)
KTVELEHTM

SEQ ID NO: 37245 - protein, 10 aa, Artificial Sequence
  Description of Artificial Sequence: Synthetic peptide
  Seed: QKRILVNLSM (KKLC1_HUMAN)
QDRILVNLSL

SEQ ID NO: 37246 - protein, 9 aa, Artificial Sequence
  Description of Artificial Sequence: Synthetic peptide
  Seed: KGFRGASPH (KKLC1_HUMAN)
KFFRGASPF

SEQ ID NO: 37247 - protein, 9 aa, Artificial Sequence
  Description of Artificial Sequence: Synthetic peptide
  Seed: SSNSTALAL (KKLC1_HUMAN)
SYNSTALAY

SEQ ID NO: 37248 - protein, 9 aa, Artificial Sequence
  Description of Artificial Sequence: Synthetic peptide
  Seed: RILVNLSMV (KKLC1_HUMAN)
RMLVNLSMA

SEQ ID NO: 37249 - protein, 9 aa, Artificial Sequence
  Description of Artificial Sequence: Synthetic peptide
  Seed: ILNNFPHSI (KKLC1_HUMAN)
IRNNFPHSL

SEQ ID NO: 37250 - protein, 11 aa, Artificial Sequence
  Description of Artificial Sequence: Synthetic peptide
  Seed: RQKRILVNLSM (KKLC1_HUMAN)
RTKRILVNLSI

SEQ ID NO: 37251 - protein, 10 aa, Artificial Sequence
  Description of Artificial Sequence: Synthetic peptide
  Seed: KLVELEHTLL (KKLC1_HUMAN)
KQVELEHTLI

SEQ ID NO: 37252 - protein, 9 aa, Artificial Sequence
  Description of Artificial Sequence: Synthetic peptide
  Seed: LLASSILCA (KKLC1_HUMAN)
LMASSILCV

SEQ ID NO: 37253 - protein, 10 aa, Artificial Sequence
  Description of Artificial Sequence: Synthetic peptide
  Seed: LASSILCALI (KKLC1_HUMAN)
LQSSILCALL

SEQ ID NO: 37254 - protein, 10 aa, Artificial Sequence
  Description of Artificial Sequence: Synthetic peptide
  Seed: LLASSILCAL (KKLC1_HUMAN)
LAASSILCAI

SEQ ID NO: 37255 - protein, 9 aa, Artificial Sequence
  Description of Artificial Sequence: Synthetic peptide
  Seed: ILNNFPHSI (KKLC1_HUMAN)
IQNNFPHSF

SEQ ID NO: 37256 - protein, 10 aa, Artificial Sequence
  Description of Artificial Sequence: Synthetic peptide
  Seed: SMVENKLVEL (KKLC1_HUMAN)
STVENKLVEL

SEQ ID NO: 37257 - protein, 11 aa, Artificial Sequence
  Description of Artificial Sequence: Synthetic peptide
  Seed: RQKRILVNLSM (KKLC1_HUMAN)
RSKRILVNLSI

SEQ ID NO: 37258 - protein, 10 aa, Artificial Sequence
  Description of Artificial Sequence: Synthetic peptide
  Seed: NKLVELEHTL (KKLC1_HUMAN)
NMLVELEHTV

SEQ ID NO: 37259 - protein, 9 aa, Artificial Sequence
  Description of Artificial Sequence: Synthetic peptide
  Seed: SNTDNNLAV (KKLC1_HUMAN)
SSTDNNLAL

SEQ ID NO: 37260 - protein, 9 aa, Artificial Sequence
  Description of Artificial Sequence: Synthetic peptide
  Seed: ILNNFPHSI (KKLC1_HUMAN)
IINNFPHSW

SEQ ID NO: 37261 - protein, 10 aa, Artificial Sequence
  Description of Artificial Sequence: Synthetic peptide
  Seed: SKGFRGASPH (KKLC1_HUMAN)
SSGFRGASPF

SEQ ID NO: 37262 - protein, 9 aa, Artificial Sequence
  Description of Artificial Sequence: Synthetic peptide
  Seed: SNSTALALV (KKLC1_HUMAN)
STSTALALA

SEQ ID NO: 37263 - protein, 9 aa, Artificial Sequence
  Description of Artificial Sequence: Synthetic peptide
  Seed: KYRRFQRNT (KKLC1_HUMAN)
KVRRFQRNK

SEQ ID NO: 37264 - protein, 10 aa, Artificial Sequence
  Description of Artificial Sequence: Synthetic peptide
  Seed: MSSNSTALAL (KKLC1_HUMAN)
MRSNSTALAW

SEQ ID NO: 37265 - protein, 10 aa, Artificial Sequence
  Description of Artificial Sequence: Synthetic peptide
  Seed: MSSNSTALAL (KKLC1_HUMAN)
MMSNSTALAA

SEQ ID NO: 37266 - protein, 9 aa, Artificial Sequence
  Description of Artificial Sequence: Synthetic peptide
  Seed: SSNSTALAL (KKLC1_HUMAN)
STNSTALAF

SEQ ID NO: 37267 - protein, 11 aa, Artificial Sequence
  Description of Artificial Sequence: Synthetic peptide
  Seed: GEMSSNSTALA (KKLC1_HUMAN)
GEMSSNSTALV

SEQ ID NO: 37268 - protein, 10 aa, Artificial Sequence
  Description of Artificial Sequence: Synthetic peptide
  Seed: NKLVELEHTL (KKLC1_HUMAN)
NWLVELEHTL

SEQ ID NO: 37269 - protein, 9 aa, Artificial Sequence
  Description of Artificial Sequence: Synthetic peptide
  Seed: KLVELEHTL (KKLC1_HUMAN)
KLVELEHTW

SEQ ID NO: 37270 - protein, 10 aa, Artificial Sequence
  Description of Artificial Sequence: Synthetic peptide
  Seed: KRILVNLSMV (KKLC1_HUMAN)
KRILVNLSMY

SEQ ID NO: 37271 - protein, 9 aa, Artificial Sequence
  Description of Artificial Sequence: Synthetic peptide
  Seed: LCALIVFWK (KKLC1_HUMAN)
LSALIVFWK

SEQ ID NO: 37272 - protein, 10 aa, Artificial Sequence
  Description of Artificial Sequence: Synthetic peptide
  Seed: RRFQRNTGEM (KKLC1_HUMAN)
RYFQRNTGEL

SEQ ID NO: 37273 - protein, 11 aa, Artificial Sequence
  Description of Artificial Sequence: Synthetic peptide
  Seed: YLLLASSILCA (KKLC1_HUMAN)
YSLLASSILCV

SEQ ID NO: 37274 - protein, 9 aa, Artificial Sequence
  Description of Artificial Sequence: Synthetic peptide
  Seed: RQKRILVNL (KKLC1_HUMAN)
RLKRILVNI

SEQ ID NO: 37275 - protein, 9 aa, Artificial Sequence
  Description of Artificial Sequence: Synthetic peptide
  Seed: LLASSILCA (KKLC1_HUMAN)
LVASSILCA

SEQ ID NO: 37276 - protein, 10 aa, Artificial Sequence
  Description of Artificial Sequence: Synthetic peptide
  Seed: SNTDNNLAVY (KKLC1_HUMAN)
SRTDNNLAVY

SEQ ID NO: 37277 - protein, 9 aa, Artificial Sequence
  Description of Artificial Sequence: Synthetic peptide
  Seed: SNTDNNLAV (KKLC1_HUMAN)
SRTDNNLAL

SEQ ID NO: 37278 - protein, 9 aa, Artificial Sequence
  Description of Artificial Sequence: Synthetic peptide
  Seed: YLLLASSIL (KKLC1_HUMAN)
YWLLASSIM

SEQ ID NO: 37279 - protein, 10 aa, Artificial Sequence
  Description of Artificial Sequence: Synthetic peptide
  Seed: SNTDNNLAVY (KKLC1_HUMAN)
SKTDNNLAVY

SEQ ID NO: 37280 - protein, 9 aa, Artificial Sequence
  Description of Artificial Sequence: Synthetic peptide
  Seed: LASSILCAL (KKLC1_HUMAN)
LTSSILCAW

SEQ ID NO: 37281 - protein, 9 aa, Artificial Sequence
  Description of Artificial Sequence: Synthetic peptide
  Seed: NNFPHSIAR (KKLC1_HUMAN)
NTFPHSIAK

SEQ ID NO: 37282 - protein, 9 aa, Artificial Sequence
  Description of Artificial Sequence: Synthetic peptide
  Seed: LASSILCAL (KKLC1_HUMAN)
LNSSILCAF

SEQ ID NO: 37283 - protein, 10 aa, Artificial Sequence
  Description of Artificial Sequence: Synthetic peptide
  Seed: MSSNSTALAL (KKLC1_HUMAN)
MPSNSTALAM

SEQ ID NO: 37284 - protein, 10 aa, Artificial Sequence
  Description of Artificial Sequence: Synthetic peptide
  Seed: SSILCALIVF (KKLC1_HUMAN)
SKILCALIVF

SEQ ID NO: 37285 - protein, 9 aa, Artificial Sequence
  Description of Artificial Sequence: Synthetic peptide
  Seed: ILNNFPHSI (KKLC1_HUMAN)
IMNNFPHSC

SEQ ID NO: 37286 - protein, 11 aa, Artificial Sequence
  Description of Artificial Sequence: Synthetic peptide
  Seed: RDILNNFPHSI (KKLC1_HUMAN)
RRILNNFPHSV

SEQ ID NO: 37287 - protein, 9 aa, Artificial Sequence
  Description of Artificial Sequence: Synthetic peptide
  Seed: LLSKGFRGA (KKLC1_HUMAN)
LVSKGFRGV

SEQ ID NO: 37288 - protein, 10 aa, Artificial Sequence
  Description of Artificial Sequence: Synthetic peptide
  Seed: SSILCALIVF (KKLC1_HUMAN)
SMILCALIVF

SEQ ID NO: 37289 - protein, 11 aa, Artificial Sequence
  Description of Artificial Sequence: Synthetic peptide
  Seed: YLLLASSILCA (KKLC1_HUMAN)
YVLLASSILCL

SEQ ID NO: 37290 - protein, 10 aa, Artificial Sequence
  Description of Artificial Sequence: Synthetic peptide
  Seed: KYRRFQRNTG (KKLC1_HUMAN)
KSRRFQRNTI

SEQ ID NO: 37291 - protein, 9 aa, Artificial Sequence
  Description of Artificial Sequence: Synthetic peptide
  Seed: KLVELEHTL (KKLC1_HUMAN)
KSVELEHTM

SEQ ID NO: 37292 - protein, 10 aa, Artificial Sequence
  Description of Artificial Sequence: Synthetic peptide
  Seed: KYRRFQRNTG (KKLC1_HUMAN)
KSRRFQRNTV

SEQ ID NO: 37293 - protein, 9 aa, Artificial Sequence
  Description of Artificial Sequence: Synthetic peptide
  Seed: VENKLVELE (KKLC1_HUMAN)
VENKLVELV

SEQ ID NO: 37294 - protein, 9 aa, Artificial Sequence
  Description of Artificial Sequence: Synthetic peptide
  Seed: IARQKRILV (KKLC1_HUMAN)
IARQKRILK

SEQ ID NO: 37295 - protein, 10 aa, Artificial Sequence
  Description of Artificial Sequence: Synthetic peptide
  Seed: YLLLASSILC (KKLC1_HUMAN)
YLLLASSILI

SEQ ID NO: 37296 - protein, 11 aa, Artificial Sequence
  Description of Artificial Sequence: Synthetic peptide
  Seed: RQKRILVNLSM (KKLC1_HUMAN)
RNKRILVNLSM

SEQ ID NO: 37297 - protein, 9 aa, Artificial Sequence
  Description of Artificial Sequence: Synthetic peptide
  Seed: KYRRFQRNT (KKLC1_HUMAN)
KIRRFQRNV

SEQ ID NO: 37298 - protein, 10 aa, Artificial Sequence
  Description of Artificial Sequence: Synthetic peptide
  Seed: KLVELEHTLL (KKLC1_HUMAN)
KVVELEHTLW

SEQ ID NO: 37299 - protein, 9 aa, Artificial Sequence
  Description of Artificial Sequence: Synthetic peptide
  Seed: IVFWKYRRF (KKLC1_HUMAN)
IAFWKYRRM

SEQ ID NO: 37300 - protein, 9 aa, Artificial Sequence
  Description of Artificial Sequence: Synthetic peptide
  Seed: YLLLASSIL (KKLC1_HUMAN)
YPLLASSIL

SEQ ID NO: 37301 - protein, 9 aa, Artificial Sequence
  Description of Artificial Sequence: Synthetic peptide
  Seed: YLLLASSIL (KKLC1_HUMAN)
YKLLASSIF

SEQ ID NO: 37302 - protein, 9 aa, Artificial Sequence
  Description of Artificial Sequence: Synthetic peptide
  Seed: ILCALIVFW (KKLC1_HUMAN)
IVCALIVFW

SEQ ID NO: 37303 - protein, 9 aa, Artificial Sequence
  Description of Artificial Sequence: Synthetic peptide
  Seed: KRILVNLSM (KKLC1_HUMAN)
KLILVNLSM

SEQ ID NO: 37304 - protein, 9 aa, Artificial Sequence
  Description of Artificial Sequence: Synthetic peptide
  Seed: KGFRGASPH (KKLC1_HUMAN)
KAFRGASPI

SEQ ID NO: 37305 - protein, 10 aa, Artificial Sequence
  Description of Artificial Sequence: Synthetic peptide
  Seed: KYRRFQRNTG (KKLC1_HUMAN)
KVRRFQRNTI

SEQ ID NO: 37306 - protein, 10 aa, Artificial Sequence
  Description of Artificial Sequence: Synthetic peptide
  Seed: LASSILCALI (KKLC1_HUMAN)
LFSSILCALW

SEQ ID NO: 37307 - protein, 9 aa, Artificial Sequence
  Description of Artificial Sequence: Synthetic peptide
  Seed: LASSILCAL (KKLC1_HUMAN)
LHSSILCAM

SEQ ID NO: 37308 - protein, 10 aa, Artificial Sequence
  Description of Artificial Sequence: Synthetic peptide
  Seed: ALVRPSSSGL (KKLC1_HUMAN)
ADVRPSSSGK

SEQ ID NO: 37309 - protein, 10 aa, Artificial Sequence
  Description of Artificial Sequence: Synthetic peptide
  Seed: QKRILVNLSM (KKLC1_HUMAN)
QMRILVNLSL

SEQ ID NO: 37310 - protein, 9 aa, Artificial Sequence
  Description of Artificial Sequence: Synthetic peptide
  Seed: SNSTALALV (KKLC1_HUMAN)
SVSTALALL

SEQ ID NO: 37311 - protein, 9 aa, Artificial Sequence
  Description of Artificial Sequence: Synthetic peptide
  Seed: KLVELEHTL (KKLC1_HUMAN)
KLVELEHTY

SEQ ID NO: 37312 - protein, 9 aa, Artificial Sequence
  Description of Artificial Sequence: Synthetic peptide
  Seed: KYRRFQRNT (KKLC1_HUMAN)
KQRRFQRNV

SEQ ID NO: 37313 - protein, 10 aa, Artificial Sequence
  Description of Artificial Sequence: Synthetic peptide
  Seed: YLLLASSILC (KKLC1_HUMAN)
YKLLASSILM

SEQ ID NO: 37314 - protein, 10 aa, Artificial Sequence
  Description of Artificial Sequence: Synthetic peptide
  Seed: ALVRPSSSGL (KKLC1_HUMAN)
APVRPSSSGF

SEQ ID NO: 37315 - protein, 10 aa, Artificial Sequence
  Description of Artificial Sequence: Synthetic peptide
  Seed: CALIVFWKYR (KKLC1_HUMAN)
CGLIVFWKYR

SEQ ID NO: 37316 - protein, 9 aa, Artificial Sequence
  Description of Artificial Sequence: Synthetic peptide
  Seed: AVYDLSRDI (KKLC1_HUMAN)
ASYDLSRDL

SEQ ID NO: 37317 - protein, 9 aa, Artificial Sequence
  Description of Artificial Sequence: Synthetic peptide
  Seed: IARQKRILV (KKLC1_HUMAN)
IPRQKRILI

SEQ ID NO: 37318 - protein, 10 aa, Artificial Sequence
  Description of Artificial Sequence: Synthetic peptide
  Seed: SNTDNNLAVY (KKLC1_HUMAN)
SGTDNNLAVY

SEQ ID NO: 37319 - protein, 9 aa, Artificial Sequence
  Description of Artificial Sequence: Synthetic peptide
  Seed: NLAVYDLSR (KKLC1_HUMAN)
NTAVYDLSK

SEQ ID NO: 37320 - protein, 9 aa, Artificial Sequence
  Description of Artificial Sequence: Synthetic peptide
  Seed: FYLLLASSI (KKLC1_HUMAN)
FRLLLASSF

SEQ ID NO: 37321 - protein, 10 aa, Artificial Sequence
  Description of Artificial Sequence: Synthetic peptide
  Seed: LASSILCALI (KKLC1_HUMAN)
LQSSILCALW

SEQ ID NO: 37322 - protein, 9 aa, Artificial Sequence
  Description of Artificial Sequence: Synthetic peptide
  Seed: LSRDILNNF (KKLC1_HUMAN)
LQRDILNNM

SEQ ID NO: 37323 - protein, 11 aa, Artificial Sequence
  Description of Artificial Sequence: Synthetic peptide
  Seed: RQKRILVNLSM (KKLC1_HUMAN)
RCKRILVNLSI

SEQ ID NO: 37324 - protein, 10 aa, Artificial Sequence
  Description of Artificial Sequence: Synthetic peptide
  Seed: SMVENKLVEL (KKLC1_HUMAN)
SRVENKLVEY

SEQ ID NO: 37325 - protein, 10 aa, Artificial Sequence
  Description of Artificial Sequence: Synthetic peptide
  Seed: YLLLASSILC (KKLC1_HUMAN)
YHLLASSILI

SEQ ID NO: 37326 - protein, 11 aa, Artificial Sequence
  Description of Artificial Sequence: Synthetic peptide
  Seed: RRFQRNTGEMS (KKLC1_HUMAN)
RRFQRNTGEMM

SEQ ID NO: 37327 - protein, 10 aa, Artificial Sequence
  Description of Artificial Sequence: Synthetic peptide
  Seed: QKRILVNLSM (KKLC1_HUMAN)
QCRILVNLSV

SEQ ID NO: 37328 - protein, 10 aa, Artificial Sequence
  Description of Artificial Sequence: Synthetic peptide
  Seed: YLLLASSILC (KKLC1_HUMAN)
YDLLASSILA

SEQ ID NO: 37329 - protein, 9 aa, Artificial Sequence
  Description of Artificial Sequence: Synthetic peptide
  Seed: RFQRNTGEM (KKLC1_HUMAN)
RFQRNTGEW

SEQ ID NO: 37330 - protein, 9 aa, Artificial Sequence
  Description of Artificial Sequence: Synthetic peptide
  Seed: KYRRFQRNT (KKLC1_HUMAN)
KLRRFQRNA

SEQ ID NO: 37331 - protein, 10 aa, Artificial Sequence
  Description of Artificial Sequence: Synthetic peptide
  Seed: KYRRFQRNTG (KKLC1_HUMAN)
KLRRFQRNTK

SEQ ID NO: 37332 - protein, 9 aa, Artificial Sequence
  Description of Artificial Sequence: Synthetic peptide
  Seed: RQKRILVNL (KKLC1_HUMAN)
REKRILVNL

SEQ ID NO: 37333 - protein, 8 aa, Artificial Sequence
  Description of Artificial Sequence: Synthetic peptide
  Seed: VYDLSRDI (KKLC1_HUMAN)
VYDLSRDM

SEQ ID NO: 37334 - protein, 9 aa, Artificial Sequence
  Description of Artificial Sequence: Synthetic peptide
  Seed: GFRGASPHR (KKLC1_HUMAN)
GVRGASPHK

SEQ ID NO: 37335 - protein, 9 aa, Artificial Sequence
  Description of Artificial Sequence: Synthetic peptide
  Seed: LIVFWKYRR (KKLC1_HUMAN)
LQVFWKYRR

SEQ ID NO: 37336 - protein, 9 aa, Artificial Sequence
  Description of Artificial Sequence: Synthetic peptide
  Seed: FWKYRRFQR (KKLC1_HUMAN)
FTKYRRFQR

SEQ ID NO: 37337 - protein, 10 aa, Artificial Sequence
  Description of Artificial Sequence: Synthetic peptide
  Seed: VELEHTLLSK (KKLC1_HUMAN)
VVLEHTLLSK

SEQ ID NO: 37338 - protein, 9 aa, Artificial Sequence
  Description of Artificial Sequence: Synthetic peptide
  Seed: IVFWKYRRF (KKLC1_HUMAN)
IAFWKYRRF

SEQ ID NO: 37339 - protein, 11 aa, Artificial Sequence
  Description of Artificial Sequence: Synthetic peptide
  Seed: MNFYLLLASSI (KKLC1_HUMAN)
MKFYLLLASSF

SEQ ID NO: 37340 - protein, 9 aa, Artificial Sequence
  Description of Artificial Sequence: Synthetic peptide
  Seed: KLVELEHTL (KKLC1_HUMAN)
KVVELEHTA

SEQ ID NO: 37341 - protein, 8 aa, Artificial Sequence
  Description of Artificial Sequence: Synthetic peptide
  Seed: NTDNNLAV (KKLC1_HUMAN)
NADNNLAM

SEQ ID NO: 37342 - protein, 10 aa, Artificial Sequence
  Description of Artificial Sequence: Synthetic peptide
  Seed: SKGFRGASPH (KKLC1_HUMAN)
SKGFRGASPY

SEQ ID NO: 37343 - protein, 9 aa, Artificial Sequence
  Description of Artificial Sequence: Synthetic peptide
  Seed: MVENKLVEL (KKLC1_HUMAN)
MMENKLVEM

SEQ ID NO: 37344 - protein, 10 aa, Artificial Sequence
  Description of Artificial Sequence: Synthetic peptide
  Seed: YLLLASSILC (KKLC1_HUMAN)
YKLLASSILI

SEQ ID NO: 37345 - protein, 11 aa, Artificial Sequence
  Description of Artificial Sequence: Synthetic peptide
  Seed: NNFPHSIARQK (KKLC1_HUMAN)
NMFPHSIARQK

SEQ ID NO: 37346 - protein, 10 aa, Artificial Sequence
  Description of Artificial Sequence: Synthetic peptide
  Seed: NFYLLLASSI (KKLC1_HUMAN)
NRYLLLASSW

SEQ ID NO: 37347 - protein, 10 aa, Artificial Sequence
  Description of Artificial Sequence: Synthetic peptide
  Seed: LASSILCALI (KKLC1_HUMAN)
LISSILCALV

SEQ ID NO: 37348 - protein, 10 aa, Artificial Sequence
  Description of Artificial Sequence: Synthetic peptide
  Seed: NFYLLLASSI (KKLC1_HUMAN)
NRYLLLASSF

SEQ ID NO: 37349 - protein, 9 aa, Artificial Sequence
  Description of Artificial Sequence: Synthetic peptide
  Seed: VELEHTLLS (KKLC1_HUMAN)
VELEHTLLV

SEQ ID NO: 37350 - protein, 9 aa, Artificial Sequence
  Description of Artificial Sequence: Synthetic peptide
  Seed: RFQRNTGEM (KKLC1_HUMAN)
RYQRNTGEM

SEQ ID NO: 37351 - protein, 9 aa, Artificial Sequence
  Description of Artificial Sequence: Synthetic peptide
  Seed: ASSILCALI (KKLC1_HUMAN)
AQSILCALV

SEQ ID NO: 37352 - protein, 9 aa, Artificial Sequence
  Description of Artificial Sequence: Synthetic peptide
  Seed: ILNNFPHSI (KKLC1_HUMAN)
IVNNFPHSW

SEQ ID NO: 37353 - protein, 10 aa, Artificial Sequence
  Description of Artificial Sequence: Synthetic peptide
  Seed: QKRILVNLSM (KKLC1_HUMAN)
QHRILVNLSL

SEQ ID NO: 37354 - protein, 10 aa, Artificial Sequence
  Description of Artificial Sequence: Synthetic peptide
  Seed: FYLLLASSIL (KKLC1_HUMAN)
FWLLLASSIF

SEQ ID NO: 37355 - protein, 10 aa, Artificial Sequence
  Description of Artificial Sequence: Synthetic peptide
  Seed: LASSILCALI (KKLC1_HUMAN)
LSSSILCALF

SEQ ID NO: 37356 - protein, 10 aa, Artificial Sequence
  Description of Artificial Sequence: Synthetic peptide
  Seed: KRILVNLSMV (KKLC1_HUMAN)
KMILVNLSMA

SEQ ID NO: 37357 - protein, 11 aa, Artificial Sequence
  Description of Artificial Sequence: Synthetic peptide
  Seed: RDILNNFPHSI (KKLC1_HUMAN)
RDILNNFPHSV

SEQ ID NO: 37358 - protein, 9 aa, Artificial Sequence
  Description of Artificial Sequence: Synthetic peptide
  Seed: IVFWKYRRF (KKLC1_HUMAN)
IAFWKYRRV

SEQ ID NO: 37359 - protein, 9 aa, Artificial Sequence
  Description of Artificial Sequence: Synthetic peptide
  Seed: LIVFWKYRR (KKLC1_HUMAN)
LMVFWKYRR

SEQ ID NO: 37360 - protein, 9 aa, Artificial Sequence
  Description of Artificial Sequence: Synthetic peptide
  Seed: NNFPHSIAR (KKLC1_HUMAN)
NAFPHSIAK

SEQ ID NO: 37361 - protein, 10 aa, Artificial Sequence
  Description of Artificial Sequence: Synthetic peptide
  Seed: SMVENKLVEL (KKLC1_HUMAN)
SSVENKLVEL

SEQ ID NO: 37362 - protein, 9 aa, Artificial Sequence
  Description of Artificial Sequence: Synthetic peptide
  Seed: RFQRNTGEM (KKLC1_HUMAN)
RYQRNTGEW

SEQ ID NO: 37363 - protein, 9 aa, Artificial Sequence
  Description of Artificial Sequence: Synthetic peptide
  Seed: LVRPSSSGL (KKLC1_HUMAN)
LMRPSSSGK

SEQ ID NO: 37364 - protein, 9 aa, Artificial Sequence
  Description of Artificial Sequence: Synthetic peptide
  Seed: NNFPHSIAR (KKLC1_HUMAN)
NVFPHSIAH

SEQ ID NO: 37365 - protein, 9 aa, Artificial Sequence
  Description of Artificial Sequence: Synthetic peptide
  Seed: LIVFWKYRR (KKLC1_HUMAN)
LWVFWKYRR

SEQ ID NO: 37366 - protein, 9 aa, Artificial Sequence
  Description of Artificial Sequence: Synthetic peptide
  Seed: RFQRNTGEM (KKLC1_HUMAN)
RWQRNTGEL

SEQ ID NO: 37367 - protein, 10 aa, Artificial Sequence
  Description of Artificial Sequence: Synthetic peptide
  Seed: QKRILVNLSM (KKLC1_HUMAN)
QQRILVNLSY

SEQ ID NO: 37368 - protein, 10 aa, Artificial Sequence
  Description of Artificial Sequence: Synthetic peptide
  Seed: YLLLASSILC (KKLC1_HUMAN)
YPLLASSILM

SEQ ID NO: 37369 - protein, 9 aa, Artificial Sequence
  Description of Artificial Sequence: Synthetic peptide
  Seed: LVRPSSSGL (KKLC1_HUMAN)
LARPSSSGK

SEQ ID NO: 37370 - protein, 9 aa, Artificial Sequence
  Description of Artificial Sequence: Synthetic peptide
  Seed: YLLLASSIL (KKLC1_HUMAN)
YSLLASSIY

SEQ ID NO: 37371 - protein, 9 aa, Artificial Sequence
  Description of Artificial Sequence: Synthetic peptide
  Seed: KLVELEHTL (KKLC1_HUMAN)
KYVELEHTM

SEQ ID NO: 37372 - protein, 11 aa, Artificial Sequence
  Description of Artificial Sequence: Synthetic peptide
  Seed: MSSNSTALALV (KKLC1_HUMAN)
MSSNSTALALF

SEQ ID NO: 37373 - protein, 11 aa, Artificial Sequence
  Description of Artificial Sequence: Synthetic peptide
  Seed: RDILNNFPHSI (KKLC1_HUMAN)
REILNNFPHSL

SEQ ID NO: 37374 - protein, 10 aa, Artificial Sequence
  Description of Artificial Sequence: Synthetic peptide
  Seed: QKRILVNLSM (KKLC1_HUMAN)
QRRILVNLSV

SEQ ID NO: 37375 - protein, 10 aa, Artificial Sequence
  Description of Artificial Sequence: Synthetic peptide
  Seed: RQKRILVNLS (KKLC1_HUMAN)
RWKRILVNLK

SEQ ID NO: 37376 - protein, 10 aa, Artificial Sequence
  Description of Artificial Sequence: Synthetic peptide
  Seed: GEMSSNSTAL (KKLC1_HUMAN)
GEMSSNSTAI

SEQ ID NO: 37377 - protein, 9 aa, Artificial Sequence
  Description of Artificial Sequence: Synthetic peptide
  Seed: ILCALIVFW (KKLC1_HUMAN)
ITCALIVFF

SEQ ID NO: 37378 - protein, 9 aa, Artificial Sequence
  Description of Artificial Sequence: Synthetic peptide
  Seed: SILCALIVF (KKLC1_HUMAN)
SQLCALIVI

SEQ ID NO: 37379 - protein, 9 aa, Artificial Sequence
  Description of Artificial Sequence: Synthetic peptide
  Seed: SNTDNNLAV (KKLC1_HUMAN)
STTDNNLAM

SEQ ID NO: 37380 - protein, 9 aa, Artificial Sequence
  Description of Artificial Sequence: Synthetic peptide
  Seed: GFRGASPHR (KKLC1_HUMAN)
GFRGASPHK

SEQ ID NO: 37381 - protein, 9 aa, Artificial Sequence
  Description of Artificial Sequence: Synthetic peptide
  Seed: KYRRFQRNT (KKLC1_HUMAN)
KSRRFQRNL

SEQ ID NO: 37382 - protein, 9 aa, Artificial Sequence
  Description of Artificial Sequence: Synthetic peptide
  Seed: IARQKRILV (KKLC1_HUMAN)
ILRQKRILL

SEQ ID NO: 37383 - protein, 10 aa, Artificial Sequence
  Description of Artificial Sequence: Synthetic peptide
  Seed: EHTLLSKGFR (KKLC1_HUMAN)
ENTLLSKGFR

SEQ ID NO: 37384 - protein, 10 aa, Artificial Sequence
  Description of Artificial Sequence: Synthetic peptide
  Seed: QKRILVNLSM (KKLC1_HUMAN)
QARILVNLSV

SEQ ID NO: 37385 - protein, 9 aa, Artificial Sequence
  Description of Artificial Sequence: Synthetic peptide
  Seed: ILNNFPHSI (KKLC1_HUMAN)
IENNFPHSY

SEQ ID NO: 37386 - protein, 10 aa, Artificial Sequence
  Description of Artificial Sequence: Synthetic peptide
  Seed: EMSSNSTALA (KKLC1_HUMAN)
ETSSNSTALV

SEQ ID NO: 37387 - protein, 10 aa, Artificial Sequence
  Description of Artificial Sequence: Synthetic peptide
  Seed: RPSSSGLINS (KKLC1_HUMAN)
RPSSSGLINM

SEQ ID NO: 37388 - protein, 10 aa, Artificial Sequence
  Description of Artificial Sequence: Synthetic peptide
  Seed: GEMSSNSTAL (KKLC1_HUMAN)
GFMSSNSTAI

SEQ ID NO: 37389 - protein, 11 aa, Artificial Sequence
  Description of Artificial Sequence: Synthetic peptide
  Seed: VFWKYRRFQRN (KKLC1_HUMAN)
VTWKYRRFQRR

SEQ ID NO: 37390 - protein, 9 aa, Artificial Sequence
  Description of Artificial Sequence: Synthetic peptide
  Seed: RQKRILVNL (KKLC1_HUMAN)
RLKRILVNL

SEQ ID NO: 37391 - protein, 10 aa, Artificial Sequence
  Description of Artificial Sequence: Synthetic peptide
  Seed: YLLLASSILC (KKLC1_HUMAN)
YFLLASSILV

SEQ ID NO: 37392 - protein, 11 aa, Artificial Sequence
  Description of Artificial Sequence: Synthetic peptide
  Seed: LLASSILCALI (KKLC1_HUMAN)
LMASSILCALV

SEQ ID NO: 37393 - protein, 9 aa, Artificial Sequence
  Description of Artificial Sequence: Synthetic peptide
  Seed: LVRPSSSGL (KKLC1_HUMAN)
LQRPSSSGL

SEQ ID NO: 37394 - protein, 10 aa, Artificial Sequence
  Description of Artificial Sequence: Synthetic peptide
  Seed: VELEHTLLSK (KKLC1_HUMAN)
VLLEHTLLSK

SEQ ID NO: 37395 - protein, 10 aa, Artificial Sequence
  Description of Artificial Sequence: Synthetic peptide
  Seed: ALIVFWKYRR (KKLC1_HUMAN)
AMIVFWKYRR

SEQ ID NO: 37396 - protein, 9 aa, Artificial Sequence
  Description of Artificial Sequence: Synthetic peptide
  Seed: EMSSNSTAL (KKLC1_HUMAN)
EMSSNSTAF

SEQ ID NO: 37397 - protein, 10 aa, Artificial Sequence
  Description of Artificial Sequence: Synthetic peptide
  Seed: MSSNSTALAL (KKLC1_HUMAN)
MKSNSTALAW

SEQ ID NO: 37398 - protein, 10 aa, Artificial Sequence
  Description of Artificial Sequence: Synthetic peptide
  Seed: NNLAVYDLSR (KKLC1_HUMAN)
NILAVYDLSR

SEQ ID NO: 37399 - protein, 9 aa, Artificial Sequence
  Description of Artificial Sequence: Synthetic peptide
  Seed: SNSTALALV (KKLC1_HUMAN)
SISTALALA

SEQ ID NO: 37400 - protein, 10 aa, Artificial Sequence
  Description of Artificial Sequence: Synthetic peptide
  Seed: SIARQKRILV (KKLC1_HUMAN)
SQARQKRILK

SEQ ID NO: 37401 - protein, 9 aa, Artificial Sequence
  Description of Artificial Sequence: Synthetic peptide
  Seed: SSNSTALAL (KKLC1_HUMAN)
SENSTALAM

SEQ ID NO: 37402 - protein, 11 aa, Artificial Sequence
  Description of Artificial Sequence: Synthetic peptide
  Seed: ILNNFPHSIAR (KKLC1_HUMAN)
IMNNFPHSIAR

SEQ ID NO: 37403 - protein, 9 aa, Artificial Sequence
  Description of Artificial Sequence: Synthetic peptide
  Seed: NNFPHSIAR (KKLC1_HUMAN)
NSFPHSIAM

SEQ ID NO: 37404 - protein, 9 aa, Artificial Sequence
  Description of Artificial Sequence: Synthetic peptide
  Seed: IARQKRILV (KKLC1_HUMAN)
ITRQKRILS

SEQ ID NO: 37405 - protein, 9 aa, Artificial Sequence
  Description of Artificial Sequence: Synthetic peptide
  Seed: KRILVNLSM (KKLC1_HUMAN)
KNILVNLSF

SEQ ID NO: 37406 - protein, 9 aa, Artificial Sequence
  Description of Artificial Sequence: Synthetic peptide
  Seed: ILNNFPHSI (KKLC1_HUMAN)
IMNNFPHSV

SEQ ID NO: 37407 - protein, 11 aa, Artificial Sequence
  Description of Artificial Sequence: Synthetic peptide
  Seed: RQKRILVNLSM (KKLC1_HUMAN)
RIKRILVNLSV

SEQ ID NO: 37408 - protein, 9 aa, Artificial Sequence
  Description of Artificial Sequence: Synthetic peptide
  Seed: NNFPHSIAR (KKLC1_HUMAN)
NCFPHSIAM

SEQ ID NO: 37409 - protein, 9 aa, Artificial Sequence
  Description of Artificial Sequence: Synthetic peptide
  Seed: MVENKLVEL (KKLC1_HUMAN)
MAENKLVEV

SEQ ID NO: 37410 - protein, 10 aa, Artificial Sequence
  Description of Artificial Sequence: Synthetic peptide
  Seed: KRILVNLSMV (KKLC1_HUMAN)
KLILVNLSML

SEQ ID NO: 37411 - protein, 9 aa, Artificial Sequence
  Description of Artificial Sequence: Synthetic peptide
  Seed: ILNNFPHSI (KKLC1_HUMAN)
IINNFPHSA

SEQ ID NO: 37412 - protein, 11 aa, Artificial Sequence
  Description of Artificial Sequence: Synthetic peptide
  Seed: RQKRILVNLSM (KKLC1_HUMAN)
RVKRILVNLSI

SEQ ID NO: 37413 - protein, 9 aa, Artificial Sequence
  Description of Artificial Sequence: Synthetic peptide
  Seed: LASSILCAL (KKLC1_HUMAN)
LASSILCAF

SEQ ID NO: 37414 - protein, 10 aa, Artificial Sequence
  Description of Artificial Sequence: Synthetic peptide
  Seed: SMVENKLVEL (KKLC1_HUMAN)
SLVENKLVEM

SEQ ID NO: 37415 - protein, 11 aa, Artificial Sequence
  Description of Artificial Sequence: Synthetic peptide
  Seed: LLLASSILCAL (KKLC1_HUMAN)
LLLASSILCAV

SEQ ID NO: 37416 - protein, 10 aa, Artificial Sequence
  Description of Artificial Sequence: Synthetic peptide
  Seed: ALIVFWKYRR (KKLC1_HUMAN)
AHIVFWKYRR

SEQ ID NO: 37417 - protein, 9 aa, Artificial Sequence
  Description of Artificial Sequence: Synthetic peptide
  Seed: SNTDNNLAV (KKLC1_HUMAN)
SATDNNLAF

SEQ ID NO: 37418 - protein, 11 aa, Artificial Sequence
  Description of Artificial Sequence: Synthetic peptide
  Seed: RQKRILVNLSM (KKLC1_HUMAN)
RSKRILVNLSM

SEQ ID NO: 37419 - protein, 10 aa, Artificial Sequence
  Description of Artificial Sequence: Synthetic peptide
  Seed: KGFRGASPHR (KKLC1_HUMAN)
KFFRGASPHA

SEQ ID NO: 37420 - protein, 10 aa, Artificial Sequence
  Description of Artificial Sequence: Synthetic peptide
  Seed: VNLSMVENKL (KKLC1_HUMAN)
VFLSMVENKL

SEQ ID NO: 37421 - protein, 10 aa, Artificial Sequence
  Description of Artificial Sequence: Synthetic peptide
  Seed: LLASSILCAL (KKLC1_HUMAN)
LTASSILCAY

SEQ ID NO: 37422 - protein, 9 aa, Artificial Sequence
  Description of Artificial Sequence: Synthetic peptide
  Seed: LSKGFRGAS (KKLC1_HUMAN)
LTKGFRGAK

SEQ ID NO: 37423 - protein, 9 aa, Artificial Sequence
  Description of Artificial Sequence: Synthetic peptide
  Seed: LASSILCAL (KKLC1_HUMAN)
LMSSILCAW

SEQ ID NO: 37424 - protein, 10 aa, Artificial Sequence
  Description of Artificial Sequence: Synthetic peptide
  Seed: LASSILCALI (KKLC1_HUMAN)
LMSSILCALS

SEQ ID NO: 37425 - protein, 9 aa, Artificial Sequence
  Description of Artificial Sequence: Synthetic peptide
  Seed: RQKRILVNL (KKLC1_HUMAN)
RFKRILVNV

SEQ ID NO: 37426 - protein, 10 aa, Artificial Sequence
  Description of Artificial Sequence: Synthetic peptide
  Seed: ILCALIVFWK (KKLC1_HUMAN)
ISCALIVFWR

SEQ ID NO: 37427 - protein, 10 aa, Artificial Sequence
  Description of Artificial Sequence: Synthetic peptide
  Seed: MSSNSTALAL (KKLC1_HUMAN)
MNSNSTALAF

SEQ ID NO: 37428 - protein, 9 aa, Artificial Sequence
  Description of Artificial Sequence: Synthetic peptide
  Seed: SNSTALALV (KKLC1_HUMAN)
SASTALALV

SEQ ID NO: 37429 - protein, 8 aa, Artificial Sequence
  Description of Artificial Sequence: Synthetic peptide
  Seed: FQRNTGEM (KKLC1_HUMAN)
FQRNTGEY

SEQ ID NO: 37430 - protein, 9 aa, Artificial Sequence
  Description of Artificial Sequence: Synthetic peptide
  Seed: SILCALIVF (KKLC1_HUMAN)
SELCALIVY

SEQ ID NO: 37431 - protein, 9 aa, Artificial Sequence
  Description of Artificial Sequence: Synthetic peptide
  Seed: LVRPSSSGL (KKLC1_HUMAN)
LPRPSSSGT

SEQ ID NO: 37432 - protein, 8 aa, Artificial Sequence
  Description of Artificial Sequence: Synthetic peptide
  Seed: VENKLVEL (KKLC1_HUMAN)
VDNKLVEF

SEQ ID NO: 37433 - protein, 9 aa, Artificial Sequence
  Description of Artificial Sequence: Synthetic peptide
  Seed: LSRDILNNF (KKLC1_HUMAN)
LTRDILNNF

SEQ ID NO: 37434 - protein, 9 aa, Artificial Sequence
  Description of Artificial Sequence: Synthetic peptide
  Seed: KYRRFQRNT (KKLC1_HUMAN)
KTRRFQRNL

SEQ ID NO: 37435 - protein, 9 aa, Artificial Sequence
  Description of Artificial Sequence: Synthetic peptide
  Seed: YLLLASSIL (KKLC1_HUMAN)
YGLLASSIF

SEQ ID NO: 37436 - protein, 10 aa, Artificial Sequence
  Description of Artificial Sequence: Synthetic peptide
  Seed: LLLASSILCA (KKLC1_HUMAN)
LMLASSILCL

SEQ ID NO: 37437 - protein, 9 aa, Artificial Sequence
  Description of Artificial Sequence: Synthetic peptide
  Seed: MVENKLVEL (KKLC1_HUMAN)
MVENKLVEV

SEQ ID NO: 37438 - protein, 9 aa, Artificial Sequence
  Description of Artificial Sequence: Synthetic peptide
  Seed: GFRGASPHR (KKLC1_HUMAN)
GTRGASPHV

SEQ ID NO: 37439 - protein, 9 aa, Artificial Sequence
  Description of Artificial Sequence: Synthetic peptide
  Seed: SNSTALALV (KKLC1_HUMAN)
SSSTALALI

SEQ ID NO: 37440 - protein, 9 aa, Artificial Sequence
  Description of Artificial Sequence: Synthetic peptide
  Seed: KGFRGASPH (KKLC1_HUMAN)
KFFRGASPY

SEQ ID NO: 37441 - protein, 10 aa, Artificial Sequence
  Description of Artificial Sequence: Synthetic peptide
  Seed: KLVELEHTLL (KKLC1_HUMAN)
KLVELEHTLW

SEQ ID NO: 37442 - protein, 9 aa, Artificial Sequence
  Description of Artificial Sequence: Synthetic peptide
  Seed: ILNNFPHSI (KKLC1_HUMAN)
INNNFPHSF

SEQ ID NO: 37443 - protein, 10 aa, Artificial Sequence
  Description of Artificial Sequence: Synthetic peptide
  Seed: KYRRFQRNTG (KKLC1_HUMAN)
KYRRFQRNTA

SEQ ID NO: 37444 - protein, 9 aa, Artificial Sequence
  Description of Artificial Sequence: Synthetic peptide
  Seed: SSNSTALAL (KKLC1_HUMAN)
SENSTALAY

SEQ ID NO: 37445 - protein, 9 aa, Artificial Sequence
  Description of Artificial Sequence: Synthetic peptide
  Seed: LSRDILNNF (KKLC1_HUMAN)
LARDILNNW

SEQ ID NO: 37446 - protein, 10 aa, Artificial Sequence
  Description of Artificial Sequence: Synthetic peptide
  Seed: LNNFPHSIAR (KKLC1_HUMAN)
LANFPHSIAR

SEQ ID NO: 37447 - protein, 9 aa, Artificial Sequence
  Description of Artificial Sequence: Synthetic peptide
  Seed: KYRRFQRNT (KKLC1_HUMAN)
KFRRFQRNS

SEQ ID NO: 37448 - protein, 9 aa, Artificial Sequence
  Description of Artificial Sequence: Synthetic peptide
  Seed: RQKRILVNL (KKLC1_HUMAN)
RVKRILVNW

SEQ ID NO: 37449 - protein, 9 aa, Artificial Sequence
  Description of Artificial Sequence: Synthetic peptide
  Seed: VYDLSRDIL (KKLC1_HUMAN)
VVDLSRDIL

SEQ ID NO: 37450 - protein, 10 aa, Artificial Sequence
  Description of Artificial Sequence: Synthetic peptide
  Seed: QKRILVNLSM (KKLC1_HUMAN)
QRRILVNLSM

SEQ ID NO: 37451 - protein, 10 aa, Artificial Sequence
  Description of Artificial Sequence: Synthetic peptide
  Seed: DILNNFPHSI (KKLC1_HUMAN)
DYLNNFPHSL

SEQ ID NO: 37452 - protein, 10 aa, Artificial Sequence
  Description of Artificial Sequence: Synthetic peptide
  Seed: LLASSILCAL (KKLC1_HUMAN)
LVASSILCAV

SEQ ID NO: 37453 - protein, 10 aa, Artificial Sequence
  Description of Artificial Sequence: Synthetic peptide
  Seed: DILNNFPHSI (KKLC1_HUMAN)
DSLNNFPHSV

SEQ ID NO: 37454 - protein, 9 aa, Artificial Sequence
  Description of Artificial Sequence: Synthetic peptide
  Seed: IVFWKYRRF (KKLC1_HUMAN)
IMFWKYRRF

SEQ ID NO: 37455 - protein, 10 aa, Artificial Sequence
  Description of Artificial Sequence: Synthetic peptide
  Seed: SNTDNNLAVY (KKLC1_HUMAN)
SQTDNNLAVY

SEQ ID NO: 37456 - protein, 10 aa, Artificial Sequence
  Description of Artificial Sequence: Synthetic peptide
  Seed: KLVELEHTLL (KKLC1_HUMAN)
KLVELEHTLR

SEQ ID NO: 37457 - protein, 9 aa, Artificial Sequence
  Description of Artificial Sequence: Synthetic peptide
  Seed: RQKRILVNL (KKLC1_HUMAN)
RQKRILVNM

SEQ ID NO: 37458 - protein, 9 aa, Artificial Sequence
  Description of Artificial Sequence: Synthetic peptide
  Seed: RQKRILVNL (KKLC1_HUMAN)
RCKRILVNK

SEQ ID NO: 37459 - protein, 9 aa, Artificial Sequence
  Description of Artificial Sequence: Synthetic peptide
  Seed: MVENKLVEL (KKLC1_HUMAN)
MEENKLVEI

SEQ ID NO: 37460 - protein, 9 aa, Artificial Sequence
  Description of Artificial Sequence: Synthetic peptide
  Seed: KYRRFQRNT (KKLC1_HUMAN)
KFRRFQRNL

SEQ ID NO: 37461 - protein, 9 aa, Artificial Sequence
  Description of Artificial Sequence: Synthetic peptide
  Seed: VYDLSRDIL (KKLC1_HUMAN)
VLDLSRDII

SEQ ID NO: 37462 - protein, 9 aa, Artificial Sequence
  Description of Artificial Sequence: Synthetic peptide
  Seed: LASSILCAL (KKLC1_HUMAN)
LVSSILCAI

SEQ ID NO: 37463 - protein, 10 aa, Artificial Sequence
  Description of Artificial Sequence: Synthetic peptide
  Seed: ALIVFWKYRR (KKLC1_HUMAN)
ATIVFWKYRR

SEQ ID NO: 37464 - protein, 9 aa, Artificial Sequence
  Description of Artificial Sequence: Synthetic peptide
  Seed: NNFPHSIAR (KKLC1_HUMAN)
NAFPHSIAY

SEQ ID NO: 37465 - protein, 9 aa, Artificial Sequence
  Description of Artificial Sequence: Synthetic peptide
  Seed: ILNNFPHSI (KKLC1_HUMAN)
IINNFPHSF

SEQ ID NO: 37466 - protein, 9 aa, Artificial Sequence
  Description of Artificial Sequence: Synthetic peptide
  Seed: MVENKLVEL (KKLC1_HUMAN)
MVENKLVEM

SEQ ID NO: 37467 - protein, 9 aa, Artificial Sequence
  Description of Artificial Sequence: Synthetic peptide
  Seed: IVFWKYRRF (KKLC1_HUMAN)
IQFWKYRRF

SEQ ID NO: 37468 - protein, 9 aa, Artificial Sequence
  Description of Artificial Sequence: Synthetic peptide
  Seed: NNFPHSIAR (KKLC1_HUMAN)
NPFPHSIAR

SEQ ID NO: 37469 - protein, 9 aa, Artificial Sequence
  Description of Artificial Sequence: Synthetic peptide
  Seed: GFRGASPHR (KKLC1_HUMAN)
GARGASPHR

SEQ ID NO: 37470 - protein, 10 aa, Artificial Sequence
  Description of Artificial Sequence: Synthetic peptide
  Seed: SKGFRGASPH (KKLC1_HUMAN)
SYGFRGASPY

SEQ ID NO: 37471 - protein, 10 aa, Artificial Sequence
  Description of Artificial Sequence: Synthetic peptide
  Seed: RRFQRNTGEM (KKLC1_HUMAN)
REFQRNTGEF

SEQ ID NO: 37472 - protein, 9 aa, Artificial Sequence
  Description of Artificial Sequence: Synthetic peptide
  Seed: MVENKLVEL (KKLC1_HUMAN)
MVENKLVEF

SEQ ID NO: 37473 - protein, 9 aa, Artificial Sequence
  Description of Artificial Sequence: Synthetic peptide
  Seed: HTLLSKGFR (KKLC1_HUMAN)
HSLLSKGFR

SEQ ID NO: 37474 - protein, 10 aa, Artificial Sequence
  Description of Artificial Sequence: Synthetic peptide
  Seed: ILCALIVFWK (KKLC1_HUMAN)
IYCALIVFWK

SEQ ID NO: 37475 - protein, 10 aa, Artificial Sequence
  Description of Artificial Sequence: Synthetic peptide
  Seed: TLLSKGFRGA (KKLC1_HUMAN)
TYLSKGFRGV

SEQ ID NO: 37476 - protein, 9 aa, Artificial Sequence
  Description of Artificial Sequence: Synthetic peptide
  Seed: SSNSTALAL (KKLC1_HUMAN)
SRNSTALAY

SEQ ID NO: 37477 - protein, 9 aa, Artificial Sequence
  Description of Artificial Sequence: Synthetic peptide
  Seed: KLVELEHTL (KKLC1_HUMAN)
KGVELEHTF

SEQ ID NO: 37478 - protein, 9 aa, Artificial Sequence
  Description of Artificial Sequence: Synthetic peptide
  Seed: MVENKLVEL (KKLC1_HUMAN)
MAENKLVEM

SEQ ID NO: 37479 - protein, 11 aa, Artificial Sequence
  Description of Artificial Sequence: Synthetic peptide
  Seed: NNFPHSIARQK (KKLC1_HUMAN)
NWFPHSIARQR

SEQ ID NO: 37480 - protein, 9 aa, Artificial Sequence
  Description of Artificial Sequence: Synthetic peptide
  Seed: SILCALIVF (KKLC1_HUMAN)
SKLCALIVF

SEQ ID NO: 37481 - protein, 9 aa, Artificial Sequence
  Description of Artificial Sequence: Synthetic peptide
  Seed: RQKRILVNL (KKLC1_HUMAN)
RVKRILVNV

SEQ ID NO: 37482 - protein, 10 aa, Artificial Sequence
  Description of Artificial Sequence: Synthetic peptide
  Seed: RRFQRNTGEM (KKLC1_HUMAN)
RVFQRNTGEF

SEQ ID NO: 37483 - protein, 10 aa, Artificial Sequence
  Description of Artificial Sequence: Synthetic peptide
  Seed: KGFRGASPHR (KKLC1_HUMAN)
KTFRGASPHM

SEQ ID NO: 37484 - protein, 10 aa, Artificial Sequence
  Description of Artificial Sequence: Synthetic peptide
  Seed: QKRILVNLSM (KKLC1_HUMAN)
QSRILVNLSI

SEQ ID NO: 37485 - protein, 9 aa, Artificial Sequence
  Description of Artificial Sequence: Synthetic peptide
  Seed: SSNSTALAL (KKLC1_HUMAN)
SENSTALAL

SEQ ID NO: 37486 - protein, 10 aa, Artificial Sequence
  Description of Artificial Sequence: Synthetic peptide
  Seed: DLSRDILNNF (KKLC1_HUMAN)
DVSRDILNNF

SEQ ID NO: 37487 - protein, 9 aa, Artificial Sequence
  Description of Artificial Sequence: Synthetic peptide
  Seed: MVENKLVEL (KKLC1_HUMAN)
MVENKLVEY

SEQ ID NO: 37488 - protein, 9 aa, Artificial Sequence
  Description of Artificial Sequence: Synthetic peptide
  Seed: KYRRFQRNT (KKLC1_HUMAN)
KTRRFQRNQ

SEQ ID NO: 37489 - protein, 10 aa, Artificial Sequence
  Description of Artificial Sequence: Synthetic peptide
  Seed: SKGFRGASPH (KKLC1_HUMAN)
SVGFRGASPF

SEQ ID NO: 37490 - protein, 10 aa, Artificial Sequence
  Description of Artificial Sequence: Synthetic peptide
  Seed: TGEMSSNSTA (KKLC1_HUMAN)
TFEMSSNSTA

SEQ ID NO: 37491 - protein, 10 aa, Artificial Sequence
  Description of Artificial Sequence: Synthetic peptide
  Seed: SSILCALIVF (KKLC1_HUMAN)
SKILCALIVM

SEQ ID NO: 37492 - protein, 9 aa, Artificial Sequence
  Description of Artificial Sequence: Synthetic peptide
  Seed: KGFRGASPH (KKLC1_HUMAN)
KKFRGASPM

SEQ ID NO: 37493 - protein, 10 aa, Artificial Sequence
  Description of Artificial Sequence: Synthetic peptide
  Seed: LLLASSILCA (KKLC1_HUMAN)
LQLASSILCL

SEQ ID NO: 37494 - protein, 10 aa, Artificial Sequence
  Description of Artificial Sequence: Synthetic peptide
  Seed: SNSTALALVR (KKLC1_HUMAN)
SISTALALVR

SEQ ID NO: 37495 - protein, 9 aa, Artificial Sequence
  Description of Artificial Sequence: Synthetic peptide
  Seed: LASSILCAL (KKLC1_HUMAN)
LLSSILCAI

SEQ ID NO: 37496 - protein, 9 aa, Artificial Sequence
  Description of Artificial Sequence: Synthetic peptide
  Seed: LASSILCAL (KKLC1_HUMAN)
LISSILCAV

SEQ ID NO: 37497 - protein, 10 aa, Artificial Sequence
  Description of Artificial Sequence: Synthetic peptide
  Seed: SSNSTALALV (KKLC1_HUMAN)
SINSTALALI

SEQ ID NO: 37498 - protein, 9 aa, Artificial Sequence
  Description of Artificial Sequence: Synthetic peptide
  Seed: EMSSNSTAL (KKLC1_HUMAN)
EQSSNSTAL

SEQ ID NO: 37499 - protein, 10 aa, Artificial Sequence
  Description of Artificial Sequence: Synthetic peptide
  Seed: LLLASSILCA (KKLC1_HUMAN)
LFLASSILCV

SEQ ID NO: 37500 - protein, 10 aa, Artificial Sequence
  Description of Artificial Sequence: Synthetic peptide
  Seed: LASSILCALI (KKLC1_HUMAN)
LMSSILCALI

SEQ ID NO: 37501 - protein, 9 aa, Artificial Sequence
  Description of Artificial Sequence: Synthetic peptide
  Seed: ILNNFPHSI (KKLC1_HUMAN)
IVNNFPHSL

SEQ ID NO: 37502 - protein, 9 aa, Artificial Sequence
  Description of Artificial Sequence: Synthetic peptide
  Seed: KGFRGASPH (KKLC1_HUMAN)
KGFRGASPM

SEQ ID NO: 37503 - protein, 9 aa, Artificial Sequence
  Description of Artificial Sequence: Synthetic peptide
  Seed: RILVNLSMV (KKLC1_HUMAN)
RLLVNLSMA

SEQ ID NO: 37504 - protein, 9 aa, Artificial Sequence
  Description of Artificial Sequence: Synthetic peptide
  Seed: LIVFWKYRR (KKLC1_HUMAN)
LTVFWKYRR

SEQ ID NO: 37505 - protein, 9 aa, Artificial Sequence
  Description of Artificial Sequence: Synthetic peptide
  Seed: LSRDILNNF (KKLC1_HUMAN)
LPRDILNNW

SEQ ID NO: 37506 - protein, 11 aa, Artificial Sequence
  Description of Artificial Sequence: Synthetic peptide
  Seed: NNFPHSIARQK (KKLC1_HUMAN)
NAFPHSIARQK

SEQ ID NO: 37507 - protein, 10 aa, Artificial Sequence
  Description of Artificial Sequence: Synthetic peptide
  Seed: SMVENKLVEL (KKLC1_HUMAN)
SAVENKLVEM

SEQ ID NO: 37508 - protein, 10 aa, Artificial Sequence
  Description of Artificial Sequence: Synthetic peptide
  Seed: LLASSILCAL (KKLC1_HUMAN)
LQASSILCAF

SEQ ID NO: 37509 - protein, 9 aa, Artificial Sequence
  Description of Artificial Sequence: Synthetic peptide
  Seed: YLLLASSIL (KKLC1_HUMAN)
YQLLASSIM

SEQ ID NO: 37510 - protein, 9 aa, Artificial Sequence
  Description of Artificial Sequence: Synthetic peptide
  Seed: SILCALIVF (KKLC1_HUMAN)
SLLCALIVY

SEQ ID NO: 37511 - protein, 9 aa, Artificial Sequence
  Description of Artificial Sequence: Synthetic peptide
  Seed: RQKRILVNL (KKLC1_HUMAN)
RSKRILVNP

SEQ ID NO: 37512 - protein, 11 aa, Artificial Sequence
  Description of Artificial Sequence: Synthetic peptide
  Seed: IVFWKYRRFQR (KKLC1_HUMAN)
IMFWKYRRFQR

SEQ ID NO: 37513 - protein, 9 aa, Artificial Sequence
  Description of Artificial Sequence: Synthetic peptide
  Seed: LSMVENKLV (KKLC1_HUMAN)
LGMVENKLW

SEQ ID NO: 37514 - protein, 9 aa, Artificial Sequence
  Description of Artificial Sequence: Synthetic peptide
  Seed: LIVFWKYRR (KKLC1_HUMAN)
LTVFWKYRK

SEQ ID NO: 37515 - protein, 9 aa, Artificial Sequence
  Description of Artificial Sequence: Synthetic peptide
  Seed: ILNNFPHSI (KKLC1_HUMAN)
IMNNFPHST

SEQ ID NO: 37516 - protein, 10 aa, Artificial Sequence
  Description of Artificial Sequence: Synthetic peptide
  Seed: LLLASSILCA (KKLC1_HUMAN)
LMLASSILCA

SEQ ID NO: 37517 - protein, 10 aa, Artificial Sequence
  Description of Artificial Sequence: Synthetic peptide
  Seed: KRILVNLSMV (KKLC1_HUMAN)
KRILVNLSMM

SEQ ID NO: 37518 - protein, 10 aa, Artificial Sequence
  Description of Artificial Sequence: Synthetic peptide
  Seed: MSSNSTALAL (KKLC1_HUMAN)
MLSNSTALAV

SEQ ID NO: 37519 - protein, 9 aa, Artificial Sequence
  Description of Artificial Sequence: Synthetic peptide
  Seed: LLLASSILC (KKLC1_HUMAN)
LILASSILI

SEQ ID NO: 37520 - protein, 9 aa, Artificial Sequence
  Description of Artificial Sequence: Synthetic peptide
  Seed: KYRRFQRNT (KKLC1_HUMAN)
KYRRFQRNA

SEQ ID NO: 37521 - protein, 9 aa, Artificial Sequence
  Description of Artificial Sequence: Synthetic peptide
  Seed: KYRRFQRNT (KKLC1_HUMAN)
KNRRFQRNK

SEQ ID NO: 37522 - protein, 9 aa, Artificial Sequence
  Description of Artificial Sequence: Synthetic peptide
  Seed: ILNNFPHSI (KKLC1_HUMAN)
ITNNFPHSI

SEQ ID NO: 37523 - protein, 9 aa, Artificial Sequence
  Description of Artificial Sequence: Synthetic peptide
  Seed: KGFRGASPH (KKLC1_HUMAN)
KMFRGASPW

SEQ ID NO: 37524 - protein, 10 aa, Artificial Sequence
  Description of Artificial Sequence: Synthetic peptide
  Seed: LASSILCALI (KKLC1_HUMAN)
LSSSILCALV

SEQ ID NO: 37525 - protein, 10 aa, Artificial Sequence
  Description of Artificial Sequence: Synthetic peptide
  Seed: RRFQRNTGEM (KKLC1_HUMAN)
RQFQRNTGEY

SEQ ID NO: 37526 - protein, 9 aa, Artificial Sequence
  Description of Artificial Sequence: Synthetic peptide
  Seed: RQKRILVNL (KKLC1_HUMAN)
RTKRILVNS

SEQ ID NO: 37527 - protein, 11 aa, Artificial Sequence
  Description of Artificial Sequence: Synthetic peptide
  Seed: YLLLASSILCA (KKLC1_HUMAN)
YYLLASSILCL

SEQ ID NO: 37528 - protein, 9 aa, Artificial Sequence
  Description of Artificial Sequence: Synthetic peptide
  Seed: KYRRFQRNT (KKLC1_HUMAN)
KYRRFQRNV

SEQ ID NO: 37529 - protein, 9 aa, Artificial Sequence
  Description of Artificial Sequence: Synthetic peptide
  Seed: YLLLASSIL (KKLC1_HUMAN)
YYLLASSIM

SEQ ID NO: 37530 - protein, 9 aa, Artificial Sequence
  Description of Artificial Sequence: Synthetic peptide
  Seed: LSRDILNNF (KKLC1_HUMAN)
LPRDILNNF

SEQ ID NO: 37531 - protein, 11 aa, Artificial Sequence
  Description of Artificial Sequence: Synthetic peptide
  Seed: LSMVENKLVEL (KKLC1_HUMAN)
LSMVENKLVEF

SEQ ID NO: 37532 - protein, 9 aa, Artificial Sequence
  Description of Artificial Sequence: Synthetic peptide
  Seed: NNFPHSIAR (KKLC1_HUMAN)
NRFPHSIAI

SEQ ID NO: 37533 - protein, 9 aa, Artificial Sequence
  Description of Artificial Sequence: Synthetic peptide
  Seed: RQKRILVNL (KKLC1_HUMAN)
RSKRILVNA

SEQ ID NO: 37534 - protein, 9 aa, Artificial Sequence
  Description of Artificial Sequence: Synthetic peptide
  Seed: YLLLASSIL (KKLC1_HUMAN)
YQLLASSIF

SEQ ID NO: 37535 - protein, 9 aa, Artificial Sequence
  Description of Artificial Sequence: Synthetic peptide
  Seed: SNSTALALV (KKLC1_HUMAN)
SQSTALALI

SEQ ID NO: 37536 - protein, 9 aa, Artificial Sequence
  Description of Artificial Sequence: Synthetic peptide
  Seed: NLAVYDLSR (KKLC1_HUMAN)
NFAVYDLSR

SEQ ID NO: 37537 - protein, 10 aa, Artificial Sequence
  Description of Artificial Sequence: Synthetic peptide
  Seed: YLLLASSILC (KKLC1_HUMAN)
YNLLASSILI

SEQ ID NO: 37538 - protein, 9 aa, Artificial Sequence
  Description of Artificial Sequence: Synthetic peptide
  Seed: SNTDNNLAV (KKLC1_HUMAN)
SSTDNNLAV

SEQ ID NO: 37539 - protein, 9 aa, Artificial Sequence
  Description of Artificial Sequence: Synthetic peptide
  Seed: LCALIVFWK (KKLC1_HUMAN)
LAALIVFWK

SEQ ID NO: 37540 - protein, 10 aa, Artificial Sequence
  Description of Artificial Sequence: Synthetic peptide
  Seed: AVYDLSRDIL (KKLC1_HUMAN)
AVYDLSRDIV

SEQ ID NO: 37541 - protein, 9 aa, Artificial Sequence
  Description of Artificial Sequence: Synthetic peptide
  Seed: NTDNNLAVY (KKLC1_HUMAN)
NLDNNLAVL

SEQ ID NO: 37542 - protein, 9 aa, Artificial Sequence
  Description of Artificial Sequence: Synthetic peptide
  Seed: ASSILCALI (KKLC1_HUMAN)
ALSILCALA

SEQ ID NO: 37543 - protein, 10 aa, Artificial Sequence
  Description of Artificial Sequence: Synthetic peptide
  Seed: NKLVELEHTL (KKLC1_HUMAN)
NRLVELEHTV

SEQ ID NO: 37544 - protein, 9 aa, Artificial Sequence
  Description of Artificial Sequence: Synthetic peptide
  Seed: ASSILCALI (KKLC1_HUMAN)
AASILCALW

SEQ ID NO: 37545 - protein, 10 aa, Artificial Sequence
  Description of Artificial Sequence: Synthetic peptide
  Seed: KLVELEHTLL (KKLC1_HUMAN)
KQVELEHTLV

SEQ ID NO: 37546 - protein, 11 aa, Artificial Sequence
  Description of Artificial Sequence: Synthetic peptide
  Seed: YLLLASSILCA (KKLC1_HUMAN)
YQLLASSILCV

SEQ ID NO: 37547 - protein, 9 aa, Artificial Sequence
  Description of Artificial Sequence: Synthetic peptide
  Seed: LASSILCAL (KKLC1_HUMAN)
LQSSILCAA

SEQ ID NO: 37548 - protein, 10 aa, Artificial Sequence
  Description of Artificial Sequence: Synthetic peptide
  Seed: KLVELEHTLL (KKLC1_HUMAN)
KMVELEHTLY

SEQ ID NO: 37549 - protein, 9 aa, Artificial Sequence
  Description of Artificial Sequence: Synthetic peptide
  Seed: ILNNFPHSI (KKLC1_HUMAN)
IGNNFPHSF

SEQ ID NO: 37550 - protein, 9 aa, Artificial Sequence
  Description of Artificial Sequence: Synthetic peptide
  Seed: MVENKLVEL (KKLC1_HUMAN)
MIENKLVEL

SEQ ID NO: 37551 - protein, 9 aa, Artificial Sequence
  Description of Artificial Sequence: Synthetic peptide
  Seed: LSRDILNNF (KKLC1_HUMAN)
LMRDILNNW

SEQ ID NO: 37552 - protein, 9 aa, Artificial Sequence
  Description of Artificial Sequence: Synthetic peptide
  Seed: FWKYRRFQR (KKLC1_HUMAN)
FGKYRRFQR

SEQ ID NO: 37553 - protein, 9 aa, Artificial Sequence
  Description of Artificial Sequence: Synthetic peptide
  Seed: NNFPHSIAR (KKLC1_HUMAN)
NSFPHSIAF

SEQ ID NO: 37554 - protein, 10 aa, Artificial Sequence
  Description of Artificial Sequence: Synthetic peptide
  Seed: DILNNFPHSI (KKLC1_HUMAN)
DFLNNFPHSA

SEQ ID NO: 37555 - protein, 9 aa, Artificial Sequence
  Description of Artificial Sequence: Synthetic peptide
  Seed: ILNNFPHSI (KKLC1_HUMAN)
IMNNFPHSY

SEQ ID NO: 37556 - protein, 9 aa, Artificial Sequence
  Description of Artificial Sequence: Synthetic peptide
  Seed: YLLLASSIL (KKLC1_HUMAN)
YILLASSIM

SEQ ID NO: 37557 - protein, 9 aa, Artificial Sequence
  Description of Artificial Sequence: Synthetic peptide
  Seed: NTDNNLAVY (KKLC1_HUMAN)
NLDNNLAVI

SEQ ID NO: 37558 - protein, 10 aa, Artificial Sequence
  Description of Artificial Sequence: Synthetic peptide
  Seed: AVYDLSRDIL (KKLC1_HUMAN)
AQYDLSRDIV

SEQ ID NO: 37559 - protein, 9 aa, Artificial Sequence
  Description of Artificial Sequence: Synthetic peptide
  Seed: NTDNNLAVY (KKLC1_HUMAN)
NPDNNLAVM

SEQ ID NO: 37560 - protein, 9 aa, Artificial Sequence
  Description of Artificial Sequence: Synthetic peptide
  Seed: KYRRFQRNT (KKLC1_HUMAN)
KTRRFQRNY

SEQ ID NO: 37561 - protein, 11 aa, Artificial Sequence
  Description of Artificial Sequence: Synthetic peptide
  Seed: KGFRGASPHRK (KKLC1_HUMAN)
KMFRGASPHRR

SEQ ID NO: 37562 - protein, 9 aa, Artificial Sequence
  Description of Artificial Sequence: Synthetic peptide
  Seed: FYLLLASSI (KKLC1_HUMAN)
FWLLLASSM

SEQ ID NO: 37563 - protein, 9 aa, Artificial Sequence
  Description of Artificial Sequence: Synthetic peptide
  Seed: MSSNSTALA (KKLC1_HUMAN)
MMSNSTALM

SEQ ID NO: 37564 - protein, 9 aa, Artificial Sequence
  Description of Artificial Sequence: Synthetic peptide
  Seed: IVFWKYRRF (KKLC1_HUMAN)
IAFWKYRRL

SEQ ID NO: 37565 - protein, 9 aa, Artificial Sequence
  Description of Artificial Sequence: Synthetic peptide
  Seed: KGFRGASPH (KKLC1_HUMAN)
KKFRGASPF

SEQ ID NO: 37566 - protein, 9 aa, Artificial Sequence
  Description of Artificial Sequence: Synthetic peptide
  Seed: IARQKRILV (KKLC1_HUMAN)
ITRQKRILI

SEQ ID NO: 37567 - protein, 9 aa, Artificial Sequence
  Description of Artificial Sequence: Synthetic peptide
  Seed: LLSKGFRGA (KKLC1_HUMAN)
LMSKGFRGV

SEQ ID NO: 37568 - protein, 9 aa, Artificial Sequence
  Description of Artificial Sequence: Synthetic peptide
  Seed: KGFRGASPH (KKLC1_HUMAN)
KVFRGASPM

SEQ ID NO: 37569 - protein, 10 aa, Artificial Sequence
  Description of Artificial Sequence: Synthetic peptide
  Seed: RQKRILVNLS (KKLC1_HUMAN)
RSKRILVNLI

SEQ ID NO: 37570 - protein, 9 aa, Artificial Sequence
  Description of Artificial Sequence: Synthetic peptide
  Seed: LVRPSSSGL (KKLC1_HUMAN)
LPRPSSSGV

SEQ ID NO: 37571 - protein, 10 aa, Artificial Sequence
  Description of Artificial Sequence: Synthetic peptide
  Seed: QKRILVNLSM (KKLC1_HUMAN)
QMRILVNLSM

SEQ ID NO: 37572 - protein, 9 aa, Artificial Sequence
  Description of Artificial Sequence: Synthetic peptide
  Seed: ILNNFPHSI (KKLC1_HUMAN)
IVNNFPHSA

SEQ ID NO: 37573 - protein, 10 aa, Artificial Sequence
  Description of Artificial Sequence: Synthetic peptide
  Seed: LNNFPHSIAR (KKLC1_HUMAN)
LSNFPHSIAR

SEQ ID NO: 37574 - protein, 9 aa, Artificial Sequence
  Description of Artificial Sequence: Synthetic peptide
  Seed: RILVNLSMV (KKLC1_HUMAN)
RVLVNLSMW

SEQ ID NO: 37575 - protein, 9 aa, Artificial Sequence
  Description of Artificial Sequence: Synthetic peptide
  Seed: FYLLLASSI (KKLC1_HUMAN)
FFLLLASSF

SEQ ID NO: 37576 - protein, 9 aa, Artificial Sequence
  Description of Artificial Sequence: Synthetic peptide
  Seed: KGFRGASPH (KKLC1_HUMAN)
KKFRGASPY

SEQ ID NO: 37577 - protein, 9 aa, Artificial Sequence
  Description of Artificial Sequence: Synthetic peptide
  Seed: KYRRFQRNT (KKLC1_HUMAN)
KSRRFQRNT

SEQ ID NO: 37578 - protein, 9 aa, Artificial Sequence
  Description of Artificial Sequence: Synthetic peptide
  Seed: LVRPSSSGL (KKLC1_HUMAN)
LSRPSSSGK

SEQ ID NO: 37579 - protein, 9 aa, Artificial Sequence
  Description of Artificial Sequence: Synthetic peptide
  Seed: KYRRFQRNT (KKLC1_HUMAN)
KVRRFQRNL

SEQ ID NO: 37580 - protein, 9 aa, Artificial Sequence
  Description of Artificial Sequence: Synthetic peptide
  Seed: SSNSTALAL (KKLC1_HUMAN)
SKNSTALAI

SEQ ID NO: 37581 - protein, 9 aa, Artificial Sequence
  Description of Artificial Sequence: Synthetic peptide
  Seed: VYDLSRDIL (KKLC1_HUMAN)
VTDLSRDII

SEQ ID NO: 37582 - protein, 9 aa, Artificial Sequence
  Description of Artificial Sequence: Synthetic peptide
  Seed: NNFPHSIAR (KKLC1_HUMAN)
NHFPHSIAY

SEQ ID NO: 37583 - protein, 9 aa, Artificial Sequence
  Description of Artificial Sequence: Synthetic peptide
  Seed: KGFRGASPH (KKLC1_HUMAN)
KNFRGASPY

SEQ ID NO: 37584 - protein, 10 aa, Artificial Sequence
  Description of Artificial Sequence: Synthetic peptide
  Seed: QKRILVNLSM (KKLC1_HUMAN)
QKRILVNLSL

SEQ ID NO: 37585 - protein, 11 aa, Artificial Sequence
  Description of Artificial Sequence: Synthetic peptide
  Seed: RQKRILVNLSM (KKLC1_HUMAN)
RIKRILVNLSK

SEQ ID NO: 37586 - protein, 10 aa, Artificial Sequence
  Description of Artificial Sequence: Synthetic peptide
  Seed: LLASSILCAL (KKLC1_HUMAN)
LVASSILCAL

SEQ ID NO: 37587 - protein, 9 aa, Artificial Sequence
  Description of Artificial Sequence: Synthetic peptide
  Seed: SSNSTALAL (KKLC1_HUMAN)
SFNSTALAM

SEQ ID NO: 37588 - protein, 10 aa, Artificial Sequence
  Description of Artificial Sequence: Synthetic peptide
  Seed: SIARQKRILV (KKLC1_HUMAN)
SVARQKRILK

SEQ ID NO: 37589 - protein, 9 aa, Artificial Sequence
  Description of Artificial Sequence: Synthetic peptide
  Seed: LASSILCAL (KKLC1_HUMAN)
LISSILCAW

SEQ ID NO: 37590 - protein, 9 aa, Artificial Sequence
  Description of Artificial Sequence: Synthetic peptide
  Seed: KLVELEHTL (KKLC1_HUMAN)
KIVELEHTM

SEQ ID NO: 37591 - protein, 9 aa, Artificial Sequence
  Description of Artificial Sequence: Synthetic peptide
  Seed: SSNSTALAL (KKLC1_HUMAN)
SDNSTALAF

SEQ ID NO: 37592 - protein, 10 aa, Artificial Sequence
  Description of Artificial Sequence: Synthetic peptide
  Seed: SMVENKLVEL (KKLC1_HUMAN)
SVVENKLVEI

SEQ ID NO: 37593 - protein, 9 aa, Artificial Sequence
  Description of Artificial Sequence: Synthetic peptide
  Seed: LASSILCAL (KKLC1_HUMAN)
LPSSILCAP

SEQ ID NO: 37594 - protein, 10 aa, Artificial Sequence
  Description of Artificial Sequence: Synthetic peptide
  Seed: QKRILVNLSM (KKLC1_HUMAN)
QDRILVNLSI

SEQ ID NO: 37595 - protein, 9 aa, Artificial Sequence
  Description of Artificial Sequence: Synthetic peptide
  Seed: GFRGASPHR (KKLC1_HUMAN)
GLRGASPHR

SEQ ID NO: 37596 - protein, 8 aa, Artificial Sequence
  Description of Artificial Sequence: Synthetic peptide
  Seed: VELEHTLL (KKLC1_HUMAN)
VELEHTLY

SEQ ID NO: 37597 - protein, 10 aa, Artificial Sequence
  Description of Artificial Sequence: Synthetic peptide
  Seed: KGFRGASPHR (KKLC1_HUMAN)
KQFRGASPHK

SEQ ID NO: 37598 - protein, 10 aa, Artificial Sequence
  Description of Artificial Sequence: Synthetic peptide
  Seed: KLVELEHTLL (KKLC1_HUMAN)
KMVELEHTLA

SEQ ID NO: 37599 - protein, 10 aa, Artificial Sequence
  Description of Artificial Sequence: Synthetic peptide
  Seed: MSSNSTALAL (KKLC1_HUMAN)
MMSNSTALAF

SEQ ID NO: 37600 - protein, 10 aa, Artificial Sequence
  Description of Artificial Sequence: Synthetic peptide
  Seed: YLLLASSILC (KKLC1_HUMAN)
YGLLASSILA

SEQ ID NO: 37601 - protein, 9 aa, Artificial Sequence
  Description of Artificial Sequence: Synthetic peptide
  Seed: LSRDILNNF (KKLC1_HUMAN)
LSRDILNNL

SEQ ID NO: 37602 - protein, 8 aa, Artificial Sequence
  Description of Artificial Sequence: Synthetic peptide
  Seed: VENKLVEL (KKLC1_HUMAN)
VENKLVEV

SEQ ID NO: 37603 - protein, 8 aa, Artificial Sequence
  Description of Artificial Sequence: Synthetic peptide
  Seed: VYDLSRDI (KKLC1_HUMAN)
VYDLSRDF

SEQ ID NO: 37604 - protein, 9 aa, Artificial Sequence
  Description of Artificial Sequence: Synthetic peptide
  Seed: RQKRILVNL (KKLC1_HUMAN)
RVKRILVNQ

SEQ ID NO: 37605 - protein, 10 aa, Artificial Sequence
  Description of Artificial Sequence: Synthetic peptide
  Seed: KYRRFQRNTG (KKLC1_HUMAN)
KVRRFQRNTS

SEQ ID NO: 37606 - protein, 11 aa, Artificial Sequence
  Description of Artificial Sequence: Synthetic peptide
  Seed: YLLLASSILCA (KKLC1_HUMAN)
YFLLASSILCL

SEQ ID NO: 37607 - protein, 9 aa, Artificial Sequence
  Description of Artificial Sequence: Synthetic peptide
  Seed: ILNNFPHSI (KKLC1_HUMAN)
IWNNFPHSI

SEQ ID NO: 37608 - protein, 10 aa, Artificial Sequence
  Description of Artificial Sequence: Synthetic peptide
  Seed: LASSILCALI (KKLC1_HUMAN)
LSSSILCALW

SEQ ID NO: 37609 - protein, 10 aa, Artificial Sequence
  Description of Artificial Sequence: Synthetic peptide
  Seed: NFYLLLASSI (KKLC1_HUMAN)
NGYLLLASSF

SEQ ID NO: 37610 - protein, 9 aa, Artificial Sequence
  Description of Artificial Sequence: Synthetic peptide
  Seed: SNSTALALV (KKLC1_HUMAN)
SMSTALALI

SEQ ID NO: 37611 - protein, 9 aa, Artificial Sequence
  Description of Artificial Sequence: Synthetic peptide
  Seed: IARQKRILV (KKLC1_HUMAN)
ISRQKRILA

SEQ ID NO: 37612 - protein, 11 aa, Artificial Sequence
  Description of Artificial Sequence: Synthetic peptide
  Seed: RDILNNFPHSI (KKLC1_HUMAN)
RLILNNFPHSV

SEQ ID NO: 37613 - protein, 9 aa, Artificial Sequence
  Description of Artificial Sequence: Synthetic peptide
  Seed: SSNSTALAL (KKLC1_HUMAN)
SFNSTALAV

SEQ ID NO: 37614 - protein, 9 aa, Artificial Sequence
  Description of Artificial Sequence: Synthetic peptide
  Seed: RQKRILVNL (KKLC1_HUMAN)
RLKRILVNM

SEQ ID NO: 37615 - protein, 10 aa, Artificial Sequence
  Description of Artificial Sequence: Synthetic peptide
  Seed: MSSNSTALAL (KKLC1_HUMAN)
MSSNSTALAF

SEQ ID NO: 37616 - protein, 10 aa, Artificial Sequence
  Description of Artificial Sequence: Synthetic peptide
  Seed: QKRILVNLSM (KKLC1_HUMAN)
QPRILVNLSM

SEQ ID NO: 37617 - protein, 10 aa, Artificial Sequence
  Description of Artificial Sequence: Synthetic peptide
  Seed: KYRRFQRNTG (KKLC1_HUMAN)
KWRRFQRNTK

SEQ ID NO: 37618 - protein, 9 aa, Artificial Sequence
  Description of Artificial Sequence: Synthetic peptide
  Seed: MVENKLVEL (KKLC1_HUMAN)
MFENKLVEM

SEQ ID NO: 37619 - protein, 10 aa, Artificial Sequence
  Description of Artificial Sequence: Synthetic peptide
  Seed: LNNFPHSIAR (KKLC1_HUMAN)
LWNFPHSIAR

SEQ ID NO: 37620 - protein, 9 aa, Artificial Sequence
  Description of Artificial Sequence: Synthetic peptide
  Seed: IARQKRILV (KKLC1_HUMAN)
IMRQKRILK

SEQ ID NO: 37621 - protein, 9 aa, Artificial Sequence
  Description of Artificial Sequence: Synthetic peptide
  Seed: LIVFWKYRR (KKLC1_HUMAN)
LAVFWKYRK

SEQ ID NO: 37622 - protein, 9 aa, Artificial Sequence
  Description of Artificial Sequence: Synthetic peptide
  Seed: NNFPHSIAR (KKLC1_HUMAN)
NAFPHSIAR

SEQ ID NO: 37623 - protein, 10 aa, Artificial Sequence
  Description of Artificial Sequence: Synthetic peptide
  Seed: TGEMSSNSTA (KKLC1_HUMAN)
TEEMSSNSTA

SEQ ID NO: 37624 - protein, 9 aa, Artificial Sequence
  Description of Artificial Sequence: Synthetic peptide
  Seed: SSNSTALAL (KKLC1_HUMAN)
SNNSTALAF

SEQ ID NO: 37625 - protein, 10 aa, Artificial Sequence
  Description of Artificial Sequence: Synthetic peptide
  Seed: QKRILVNLSM (KKLC1_HUMAN)
QKRILVNLSI

SEQ ID NO: 37626 - protein, 10 aa, Artificial Sequence
  Description of Artificial Sequence: Synthetic peptide
  Seed: LASSILCALI (KKLC1_HUMAN)
LISSILCALL

SEQ ID NO: 37627 - protein, 10 aa, Artificial Sequence
  Description of Artificial Sequence: Synthetic peptide
  Seed: GEMSSNSTAL (KKLC1_HUMAN)
GQMSSNSTAV

SEQ ID NO: 37628 - protein, 10 aa, Artificial Sequence
  Description of Artificial Sequence: Synthetic peptide
  Seed: LNNFPHSIAR (KKLC1_HUMAN)
LQNFPHSIAR

SEQ ID NO: 37629 - protein, 9 aa, Artificial Sequence
  Description of Artificial Sequence: Synthetic peptide
  Seed: CALIVFWKY (KKLC1_HUMAN)
CYLIVFWKY

SEQ ID NO: 37630 - protein, 10 aa, Artificial Sequence
  Description of Artificial Sequence: Synthetic peptide
  Seed: LLASSILCAL (KKLC1_HUMAN)
LQASSILCAM

SEQ ID NO: 37631 - protein, 9 aa, Artificial Sequence
  Description of Artificial Sequence: Synthetic peptide
  Seed: CALIVFWKY (KKLC1_HUMAN)
CILIVFWKY

SEQ ID NO: 37632 - protein, 10 aa, Artificial Sequence
  Description of Artificial Sequence: Synthetic peptide
  Seed: LASSILCALI (KKLC1_HUMAN)
LTSSILCALV

SEQ ID NO: 37633 - protein, 10 aa, Artificial Sequence
  Description of Artificial Sequence: Synthetic peptide
  Seed: QKRILVNLSM (KKLC1_HUMAN)
QWRILVNLSV

SEQ ID NO: 37634 - protein, 8 aa, Artificial Sequence
  Description of Artificial Sequence: Synthetic peptide
  Seed: VYDLSRDI (KKLC1_HUMAN)
VWDLSRDM

SEQ ID NO: 37635 - protein, 9 aa, Artificial Sequence
  Description of Artificial Sequence: Synthetic peptide
  Seed: RILVNLSMV (KKLC1_HUMAN)
RLLVNLSMV

SEQ ID NO: 37636 - protein, 10 aa, Artificial Sequence
  Description of Artificial Sequence: Synthetic peptide
  Seed: GEMSSNSTAL (KKLC1_HUMAN)
GQMSSNSTAL

SEQ ID NO: 37637 - protein, 11 aa, Artificial Sequence
  Description of Artificial Sequence: Synthetic peptide
  Seed: IVFWKYRRFQR (KKLC1_HUMAN)
ISFWKYRRFQR

SEQ ID NO: 37638 - protein, 10 aa, Artificial Sequence
  Description of Artificial Sequence: Synthetic peptide
  Seed: MSSNSTALAL (KKLC1_HUMAN)
MYSNSTALAF

SEQ ID NO: 37639 - protein, 9 aa, Artificial Sequence
  Description of Artificial Sequence: Synthetic peptide
  Seed: KGFRGASPH (KKLC1_HUMAN)
KMFRGASPA

SEQ ID NO: 37640 - protein, 9 aa, Artificial Sequence
  Description of Artificial Sequence: Synthetic peptide
  Seed: SNSTALALV (KKLC1_HUMAN)
SLSTALALI

SEQ ID NO: 37641 - protein, 9 aa, Artificial Sequence
  Description of Artificial Sequence: Synthetic peptide
  Seed: LVRPSSSGL (KKLC1_HUMAN)
LVRPSSSGF

SEQ ID NO: 37642 - protein, 9 aa, Artificial Sequence
  Description of Artificial Sequence: Synthetic peptide
  Seed: VYDLSRDIL (KKLC1_HUMAN)
VSDLSRDII

SEQ ID NO: 37643 - protein, 10 aa, Artificial Sequence
  Description of Artificial Sequence: Synthetic peptide
  Seed: YLLLASSILC (KKLC1_HUMAN)
YGLLASSILM

SEQ ID NO: 37644 - protein, 9 aa, Artificial Sequence
  Description of Artificial Sequence: Synthetic peptide
  Seed: RQKRILVNL (KKLC1_HUMAN)
RSKRILVNT

SEQ ID NO: 37645 - protein, 9 aa, Artificial Sequence
  Description of Artificial Sequence: Synthetic peptide
  Seed: YLLLASSIL (KKLC1_HUMAN)
YVLLASSIL

SEQ ID NO: 37646 - protein, 9 aa, Artificial Sequence
  Description of Artificial Sequence: Synthetic peptide
  Seed: LVRPSSSGL (KKLC1_HUMAN)
LSRPSSSGA

SEQ ID NO: 37647 - protein, 10 aa, Artificial Sequence
  Description of Artificial Sequence: Synthetic peptide
  Seed: SMVENKLVEL (KKLC1_HUMAN)
SLVENKLVEL

SEQ ID NO: 37648 - protein, 10 aa, Artificial Sequence
  Description of Artificial Sequence: Synthetic peptide
  Seed: LASSILCALI (KKLC1_HUMAN)
LLSSILCALE

SEQ ID NO: 37649 - protein, 9 aa, Artificial Sequence
  Description of Artificial Sequence: Synthetic peptide
  Seed: MVENKLVEL (KKLC1_HUMAN)
MRENKLVEL

SEQ ID NO: 37650 - protein, 9 aa, Artificial Sequence
  Description of Artificial Sequence: Synthetic peptide
  Seed: SSNSTALAL (KKLC1_HUMAN)
SANSTALAV

SEQ ID NO: 37651 - protein, 9 aa, Artificial Sequence
  Description of Artificial Sequence: Synthetic peptide
  Seed: MVENKLVEL (KKLC1_HUMAN)
MTENKLVEI

SEQ ID NO: 37652 - protein, 9 aa, Artificial Sequence
  Description of Artificial Sequence: Synthetic peptide
  Seed: SNTDNNLAV (KKLC1_HUMAN)
SATDNNLAV

SEQ ID NO: 37653 - protein, 11 aa, Artificial Sequence
  Description of Artificial Sequence: Synthetic peptide
  Seed: MSSNSTALALV (KKLC1_HUMAN)
MGSNSTALALW

SEQ ID NO: 37654 - protein, 9 aa, Artificial Sequence
  Description of Artificial Sequence: Synthetic peptide
  Seed: IARQKRILV (KKLC1_HUMAN)
IIRQKRILK

SEQ ID NO: 37655 - protein, 10 aa, Artificial Sequence
  Description of Artificial Sequence: Synthetic peptide
  Seed: VFWKYRRFQR (KKLC1_HUMAN)
VWWKYRRFQK

SEQ ID NO: 37656 - protein, 10 aa, Artificial Sequence
  Description of Artificial Sequence: Synthetic peptide
  Seed: MSSNSTALAL (KKLC1_HUMAN)
MQSNSTALAV

SEQ ID NO: 37657 - protein, 9 aa, Artificial Sequence
  Description of Artificial Sequence: Synthetic peptide
  Seed: RQKRILVNL (KKLC1_HUMAN)
RTKRILVNQ

SEQ ID NO: 37658 - protein, 9 aa, Artificial Sequence
  Description of Artificial Sequence: Synthetic peptide
  Seed: NTDNNLAVY (KKLC1_HUMAN)
NYDNNLAVY

SEQ ID NO: 37659 - protein, 9 aa, Artificial Sequence
  Description of Artificial Sequence: Synthetic peptide
  Seed: RQKRILVNL (KKLC1_HUMAN)
RNKRILVNY

SEQ ID NO: 37660 - protein, 10 aa, Artificial Sequence
  Description of Artificial Sequence: Synthetic peptide
  Seed: SILCALIVFW (KKLC1_HUMAN)
SSLCALIVFW

SEQ ID NO: 37661 - protein, 10 aa, Artificial Sequence
  Description of Artificial Sequence: Synthetic peptide
  Seed: LASSILCALI (KKLC1_HUMAN)
LLSSILCALK

SEQ ID NO: 37662 - protein, 9 aa, Artificial Sequence
  Description of Artificial Sequence: Synthetic peptide
  Seed: MVENKLVEL (KKLC1_HUMAN)
MQENKLVEF

SEQ ID NO: 37663 - protein, 9 aa, Artificial Sequence
  Description of Artificial Sequence: Synthetic peptide
  Seed: YLLLASSIL (KKLC1_HUMAN)
YMLLASSII

SEQ ID NO: 37664 - protein, 9 aa, Artificial Sequence
  Description of Artificial Sequence: Synthetic peptide
  Seed: ASSILCALI (KKLC1_HUMAN)
AMSILCALI

SEQ ID NO: 37665 - protein, 9 aa, Artificial Sequence
  Description of Artificial Sequence: Synthetic peptide
  Seed: KLVELEHTL (KKLC1_HUMAN)
KIVELEHTV

SEQ ID NO: 37666 - protein, 9 aa, Artificial Sequence
  Description of Artificial Sequence: Synthetic peptide
  Seed: ILNNFPHSI (KKLC1_HUMAN)
ISNNFPHSY

SEQ ID NO: 37667 - protein, 9 aa, Artificial Sequence
  Description of Artificial Sequence: Synthetic peptide
  Seed: LASSILCAL (KKLC1_HUMAN)
LSSSILCAV

SEQ ID NO: 37668 - protein, 10 aa, Artificial Sequence
  Description of Artificial Sequence: Synthetic peptide
  Seed: MSSNSTALAL (KKLC1_HUMAN)
MGSNSTALAY

SEQ ID NO: 37669 - protein, 9 aa, Artificial Sequence
  Description of Artificial Sequence: Synthetic peptide
  Seed: LASSILCAL (KKLC1_HUMAN)
LISSILCAT

SEQ ID NO: 37670 - protein, 10 aa, Artificial Sequence
  Description of Artificial Sequence: Synthetic peptide
  Seed: NKLVELEHTL (KKLC1_HUMAN)
NYLVELEHTL

SEQ ID NO: 37671 - protein, 10 aa, Artificial Sequence
  Description of Artificial Sequence: Synthetic peptide
  Seed: LASSILCALI (KKLC1_HUMAN)
LTSSILCALW

SEQ ID NO: 37672 - protein, 9 aa, Artificial Sequence
  Description of Artificial Sequence: Synthetic peptide
  Seed: SNTDNNLAV (KKLC1_HUMAN)
SATDNNLAL

SEQ ID NO: 37673 - protein, 10 aa, Artificial Sequence
  Description of Artificial Sequence: Synthetic peptide
  Seed: MSSNSTALAL (KKLC1_HUMAN)
MESNSTALAW

SEQ ID NO: 37674 - protein, 9 aa, Artificial Sequence
  Description of Artificial Sequence: Synthetic peptide
  Seed: KRILVNLSM (KKLC1_HUMAN)
KQILVNLSV

SEQ ID NO: 37675 - protein, 10 aa, Artificial Sequence
  Description of Artificial Sequence: Synthetic peptide
  Seed: SNTDNNLAVY (KKLC1_HUMAN)
SCTDNNLAVY

SEQ ID NO: 37676 - protein, 9 aa, Artificial Sequence
  Description of Artificial Sequence: Synthetic peptide
  Seed: SSNSTALAL (KKLC1_HUMAN)
SENSTALAV

SEQ ID NO: 37677 - protein, 10 aa, Artificial Sequence
  Description of Artificial Sequence: Synthetic peptide
  Seed: SMVENKLVEL (KKLC1_HUMAN)
SQVENKLVEF

SEQ ID NO: 37678 - protein, 9 aa, Artificial Sequence
  Description of Artificial Sequence: Synthetic peptide
  Seed: VYDLSRDIL (KKLC1_HUMAN)
VLDLSRDIM

SEQ ID NO: 37679 - protein, 11 aa, Artificial Sequence
  Description of Artificial Sequence: Synthetic peptide
  Seed: RQKRILVNLSM (KKLC1_HUMAN)
RNKRILVNLSK

SEQ ID NO: 37680 - protein, 10 aa, Artificial Sequence
  Description of Artificial Sequence: Synthetic peptide
  Seed: RQKRILVNLS (KKLC1_HUMAN)
RSKRILVNLK

SEQ ID NO: 37681 - protein, 11 aa, Artificial Sequence
  Description of Artificial Sequence: Synthetic peptide
  Seed: RDILNNFPHSI (KKLC1_HUMAN)
RLILNNFPHSI

SEQ ID NO: 37682 - protein, 10 aa, Artificial Sequence
  Description of Artificial Sequence: Synthetic peptide
  Seed: QKRILVNLSM (KKLC1_HUMAN)
QARILVNLSM

SEQ ID NO: 37683 - protein, 9 aa, Artificial Sequence
  Description of Artificial Sequence: Synthetic peptide
  Seed: NNFPHSIAR (KKLC1_HUMAN)
NWFPHSIAL

SEQ ID NO: 37684 - protein, 9 aa, Artificial Sequence
  Description of Artificial Sequence: Synthetic peptide
  Seed: LVRPSSSGL (KKLC1_HUMAN)
LYRPSSSGK

SEQ ID NO: 37685 - protein, 10 aa, Artificial Sequence
  Description of Artificial Sequence: Synthetic peptide
  Seed: MSSNSTALAL (KKLC1_HUMAN)
MESNSTALAY

SEQ ID NO: 37686 - protein, 9 aa, Artificial Sequence
  Description of Artificial Sequence: Synthetic peptide
  Seed: KGFRGASPH (KKLC1_HUMAN)
KIFRGASPL

SEQ ID NO: 37687 - protein, 9 aa, Artificial Sequence
  Description of Artificial Sequence: Synthetic peptide
  Seed: LSRDILNNF (KKLC1_HUMAN)
LYRDILNNY

SEQ ID NO: 37688 - protein, 9 aa, Artificial Sequence
  Description of Artificial Sequence: Synthetic peptide
  Seed: SILCALIVF (KKLC1_HUMAN)
SMLCALIVW

SEQ ID NO: 37689 - protein, 9 aa, Artificial Sequence
  Description of Artificial Sequence: Synthetic peptide
  Seed: VNLSMVENK (KKLC1_HUMAN)
VMLSMVENK

SEQ ID NO: 37690 - protein, 11 aa, Artificial Sequence
  Description of Artificial Sequence: Synthetic peptide
  Seed: RQKRILVNLSM (KKLC1_HUMAN)
RMKRILVNLSF

SEQ ID NO: 37691 - protein, 10 aa, Artificial Sequence
  Description of Artificial Sequence: Synthetic peptide
  Seed: KYRRFQRNTG (KKLC1_HUMAN)
KVRRFQRNTY

SEQ ID NO: 37692 - protein, 9 aa, Artificial Sequence
  Description of Artificial Sequence: Synthetic peptide
  Seed: KLVELEHTL (KKLC1_HUMAN)
KLVELEHTA

SEQ ID NO: 37693 - protein, 10 aa, Artificial Sequence
  Description of Artificial Sequence: Synthetic peptide
  Seed: MSSNSTALAL (KKLC1_HUMAN)
MKSNSTALAY

SEQ ID NO: 37694 - protein, 9 aa, Artificial Sequence
  Description of Artificial Sequence: Synthetic peptide
  Seed: KGFRGASPH (KKLC1_HUMAN)
KKFRGASPL

SEQ ID NO: 37695 - protein, 8 aa, Artificial Sequence
  Description of Artificial Sequence: Synthetic peptide
  Seed: NTDNNLAV (KKLC1_HUMAN)
NADNNLAF

SEQ ID NO: 37696 - protein, 9 aa, Artificial Sequence
  Description of Artificial Sequence: Synthetic peptide
  Seed: KLVELEHTL (KKLC1_HUMAN)
KMVELEHTT

SEQ ID NO: 37697 - protein, 9 aa, Artificial Sequence
  Description of Artificial Sequence: Synthetic peptide
  Seed: RQKRILVNL (KKLC1_HUMAN)
RSKRILVNH

SEQ ID NO: 37698 - protein, 9 aa, Artificial Sequence
  Description of Artificial Sequence: Synthetic peptide
  Seed: SSNSTALAL (KKLC1_HUMAN)
SRNSTALAV

SEQ ID NO: 37699 - protein, 10 aa, Artificial Sequence
  Description of Artificial Sequence: Synthetic peptide
  Seed: YLLLASSILC (KKLC1_HUMAN)
YWLLASSILL

SEQ ID NO: 37700 - protein, 10 aa, Artificial Sequence
  Description of Artificial Sequence: Synthetic peptide
  Seed: GEMSSNSTAL (KKLC1_HUMAN)
GYMSSNSTAL

SEQ ID NO: 37701 - protein, 9 aa, Artificial Sequence
  Description of Artificial Sequence: Synthetic peptide
  Seed: KRILVNLSM (KKLC1_HUMAN)
KMILVNLSF

SEQ ID NO: 37702 - protein, 10 aa, Artificial Sequence
  Description of Artificial Sequence: Synthetic peptide
  Seed: NNLAVYDLSR (KKLC1_HUMAN)
NFLAVYDLSR

SEQ ID NO: 37703 - protein, 9 aa, Artificial Sequence
  Description of Artificial Sequence: Synthetic peptide
  Seed: LASSILCAL (KKLC1_HUMAN)
LESSILCAM

SEQ ID NO: 37704 - protein, 11 aa, Artificial Sequence
  Description of Artificial Sequence: Synthetic peptide
  Seed: RDILNNFPHSI (KKLC1_HUMAN)
REILNNFPHSV

SEQ ID NO: 37705 - protein, 11 aa, Artificial Sequence
  Description of Artificial Sequence: Synthetic peptide
  Seed: RQKRILVNLSM (KKLC1_HUMAN)
RLKRILVNLSL

SEQ ID NO: 37706 - protein, 9 aa, Artificial Sequence
  Description of Artificial Sequence: Synthetic peptide
  Seed: YLLLASSIL (KKLC1_HUMAN)
YKLLASSII

SEQ ID NO: 37707 - protein, 9 aa, Artificial Sequence
  Description of Artificial Sequence: Synthetic peptide
  Seed: KRILVNLSM (KKLC1_HUMAN)
KKILVNLSI

SEQ ID NO: 37708 - protein, 9 aa, Artificial Sequence
  Description of Artificial Sequence: Synthetic peptide
  Seed: KRILVNLSM (KKLC1_HUMAN)
KRILVNLSY

SEQ ID NO: 37709 - protein, 9 aa, Artificial Sequence
  Description of Artificial Sequence: Synthetic peptide
  Seed: FPHSIARQK (KKLC1_HUMAN)
FPHSIARQI

SEQ ID NO: 37710 - protein, 9 aa, Artificial Sequence
  Description of Artificial Sequence: Synthetic peptide
  Seed: LEHTLLSKG (KKLC1_HUMAN)
LEHTLLSKL

SEQ ID NO: 37711 - protein, 10 aa, Artificial Sequence
  Description of Artificial Sequence: Synthetic peptide
  Seed: NNLAVYDLSR (KKLC1_HUMAN)
NVLAVYDLSR

SEQ ID NO: 37712 - protein, 9 aa, Artificial Sequence
  Description of Artificial Sequence: Synthetic peptide
  Seed: SNSTALALV (KKLC1_HUMAN)
SSSTALALL

SEQ ID NO: 37713 - protein, 10 aa, Artificial Sequence
  Description of Artificial Sequence: Synthetic peptide
  Seed: EMSSNSTALA (KKLC1_HUMAN)
EQSSNSTALV

SEQ ID NO: 37714 - protein, 9 aa, Artificial Sequence
  Description of Artificial Sequence: Synthetic peptide
  Seed: MVENKLVEL (KKLC1_HUMAN)
MQENKLVEM

SEQ ID NO: 37715 - protein, 10 aa, Artificial Sequence
  Description of Artificial Sequence: Synthetic peptide
  Seed: YLLLASSILC (KKLC1_HUMAN)
YRLLASSILA

SEQ ID NO: 37716 - protein, 11 aa, Artificial Sequence
  Description of Artificial Sequence: Synthetic peptide
  Seed: RQKRILVNLSM (KKLC1_HUMAN)
RRKRILVNLSM

SEQ ID NO: 37717 - protein, 9 aa, Artificial Sequence
  Description of Artificial Sequence: Synthetic peptide
  Seed: KYRRFQRNT (KKLC1_HUMAN)
KIRRFQRNY

SEQ ID NO: 37718 - protein, 9 aa, Artificial Sequence
  Description of Artificial Sequence: Synthetic peptide
  Seed: MVENKLVEL (KKLC1_HUMAN)
MFENKLVEV

SEQ ID NO: 37719 - protein, 9 aa, Artificial Sequence
  Description of Artificial Sequence: Synthetic peptide
  Seed: GASPHRKST (KKLC1_HUMAN)
GASPHRKSF

SEQ ID NO: 37720 - protein, 9 aa, Artificial Sequence
  Description of Artificial Sequence: Synthetic peptide
  Seed: KRILVNLSM (KKLC1_HUMAN)
KQILVNLSM

SEQ ID NO: 37721 - protein, 11 aa, Artificial Sequence
  Description of Artificial Sequence: Synthetic peptide
  Seed: RQKRILVNLSM (KKLC1_HUMAN)
RAKRILVNLSI

SEQ ID NO: 37722 - protein, 10 aa, Artificial Sequence
  Description of Artificial Sequence: Synthetic peptide
  Seed: KYRRFQRNTG (KKLC1_HUMAN)
KTRRFQRNTV

SEQ ID NO: 37723 - protein, 9 aa, Artificial Sequence
  Description of Artificial Sequence: Synthetic peptide
  Seed: NNFPHSIAR (KKLC1_HUMAN)
NFFPHSIAM

SEQ ID NO: 37724 - protein, 9 aa, Artificial Sequence
  Description of Artificial Sequence: Synthetic peptide
  Seed: NNFPHSIAR (KKLC1_HUMAN)
NWFPHSIAF

SEQ ID NO: 37725 - protein, 9 aa, Artificial Sequence
  Description of Artificial Sequence: Synthetic peptide
  Seed: NNFPHSIAR (KKLC1_HUMAN)
NYFPHSIAF

SEQ ID NO: 37726 - protein, 9 aa, Artificial Sequence
  Description of Artificial Sequence: Synthetic peptide
  Seed: VYDLSRDIL (KKLC1_HUMAN)
VYDLSRDIV

SEQ ID NO: 37727 - protein, 9 aa, Artificial Sequence
  Description of Artificial Sequence: Synthetic peptide
  Seed: YLLLASSIL (KKLC1_HUMAN)
YFLLASSIM

SEQ ID NO: 37728 - protein, 9 aa, Artificial Sequence
  Description of Artificial Sequence: Synthetic peptide
  Seed: LSRDILNNF (KKLC1_HUMAN)
LIRDILNNF

SEQ ID NO: 37729 - protein, 10 aa, Artificial Sequence
  Description of Artificial Sequence: Synthetic peptide
  Seed: NNLAVYDLSR (KKLC1_HUMAN)
NMLAVYDLSR

SEQ ID NO: 37730 - protein, 9 aa, Artificial Sequence
  Description of Artificial Sequence: Synthetic peptide
  Seed: SSNSTALAL (KKLC1_HUMAN)
SWNSTALAM

SEQ ID NO: 37731 - protein, 9 aa, Artificial Sequence
  Description of Artificial Sequence: Synthetic peptide
  Seed: RQKRILVNL (KKLC1_HUMAN)
RYKRILVNY

SEQ ID NO: 37732 - protein, 11 aa, Artificial Sequence
  Description of Artificial Sequence: Synthetic peptide
  Seed: SILCALIVFWK (KKLC1_HUMAN)
STLCALIVFWR

SEQ ID NO: 37733 - protein, 10 aa, Artificial Sequence
  Description of Artificial Sequence: Synthetic peptide
  Seed: LVNLSMVENK (KKLC1_HUMAN)
LTNLSMVENK

SEQ ID NO: 37734 - protein, 11 aa, Artificial Sequence
  Description of Artificial Sequence: Synthetic peptide
  Seed: RQKRILVNLSM (KKLC1_HUMAN)
RMKRILVNLSY

SEQ ID NO: 37735 - protein, 10 aa, Artificial Sequence
  Description of Artificial Sequence: Synthetic peptide
  Seed: SMVENKLVEL (KKLC1_HUMAN)
SAVENKLVEL

SEQ ID NO: 37736 - protein, 10 aa, Artificial Sequence
  Description of Artificial Sequence: Synthetic peptide
  Seed: KGFRGASPHR (KKLC1_HUMAN)
KVFRGASPHR

SEQ ID NO: 37737 - protein, 10 aa, Artificial Sequence
  Description of Artificial Sequence: Synthetic peptide
  Seed: LASSILCALI (KKLC1_HUMAN)
LSSSILCALM

SEQ ID NO: 37738 - protein, 9 aa, Artificial Sequence
  Description of Artificial Sequence: Synthetic peptide
  Seed: RILVNLSMV (KKLC1_HUMAN)
RLLVNLSML

SEQ ID NO: 37739 - protein, 10 aa, Artificial Sequence
  Description of Artificial Sequence: Synthetic peptide
  Seed: YLLLASSILC (KKLC1_HUMAN)
YTLLASSILA

SEQ ID NO: 37740 - protein, 9 aa, Artificial Sequence
  Description of Artificial Sequence: Synthetic peptide
  Seed: LSMVENKLV (KKLC1_HUMAN)
LAMVENKLF

SEQ ID NO: 37741 - protein, 9 aa, Artificial Sequence
  Description of Artificial Sequence: Synthetic peptide
  Seed: SNSTALALV (KKLC1_HUMAN)
SQSTALALL

SEQ ID NO: 37742 - protein, 9 aa, Artificial Sequence
  Description of Artificial Sequence: Synthetic peptide
  Seed: RILVNLSMV (KKLC1_HUMAN)
RQLVNLSMV

SEQ ID NO: 37743 - protein, 10 aa, Artificial Sequence
  Description of Artificial Sequence: Synthetic peptide
  Seed: EHTLLSKGFR (KKLC1_HUMAN)
EVTLLSKGFK

SEQ ID NO: 37744 - protein, 10 aa, Artificial Sequence
  Description of Artificial Sequence: Synthetic peptide
  Seed: FYLLLASSIL (KKLC1_HUMAN)
FRLLLASSIV

SEQ ID NO: 37745 - protein, 9 aa, Artificial Sequence
  Description of Artificial Sequence: Synthetic peptide
  Seed: SILCALIVF (KKLC1_HUMAN)
SSLCALIVW

SEQ ID NO: 37746 - protein, 9 aa, Artificial Sequence
  Description of Artificial Sequence: Synthetic peptide
  Seed: KRILVNLSM (KKLC1_HUMAN)
KQILVNLSL

SEQ ID NO: 37747 - protein, 10 aa, Artificial Sequence
  Description of Artificial Sequence: Synthetic peptide
  Seed: ILCALIVFWK (KKLC1_HUMAN)
IWCALIVFWR

SEQ ID NO: 37748 - protein, 10 aa, Artificial Sequence
  Description of Artificial Sequence: Synthetic peptide
  Seed: QKRILVNLSM (KKLC1_HUMAN)
QQRILVNLSI

SEQ ID NO: 37749 - protein, 9 aa, Artificial Sequence
  Description of Artificial Sequence: Synthetic peptide
  Seed: YLLLASSIL (KKLC1_HUMAN)
YILLASSIF

SEQ ID NO: 37750 - protein, 9 aa, Artificial Sequence
  Description of Artificial Sequence: Synthetic peptide
  Seed: NTDNNLAVY (KKLC1_HUMAN)
NIDNNLAVV

SEQ ID NO: 37751 - protein, 9 aa, Artificial Sequence
  Description of Artificial Sequence: Synthetic peptide
  Seed: RILVNLSMV (KKLC1_HUMAN)
RLLVNLSMF

SEQ ID NO: 37752 - protein, 10 aa, Artificial Sequence
  Description of Artificial Sequence: Synthetic peptide
  Seed: KGFRGASPHR (KKLC1_HUMAN)
KFFRGASPHK

SEQ ID NO: 37753 - protein, 9 aa, Artificial Sequence
  Description of Artificial Sequence: Synthetic peptide
  Seed: NNFPHSIAR (KKLC1_HUMAN)
NTFPHSIAV

SEQ ID NO: 37754 - protein, 11 aa, Artificial Sequence
  Description of Artificial Sequence: Synthetic peptide
  Seed: MNFYLLLASSI (KKLC1_HUMAN)
MGFYLLLASSF

SEQ ID NO: 37755 - protein, 9 aa, Artificial Sequence
  Description of Artificial Sequence: Synthetic peptide
  Seed: SNSTALALV (KKLC1_HUMAN)
SISTALALM

SEQ ID NO: 37756 - protein, 9 aa, Artificial Sequence
  Description of Artificial Sequence: Synthetic peptide
  Seed: ALIVFWKYR (KKLC1_HUMAN)
ALIVFWKYK

SEQ ID NO: 37757 - protein, 9 aa, Artificial Sequence
  Description of Artificial Sequence: Synthetic peptide
  Seed: KYRRFQRNT (KKLC1_HUMAN)
KSRRFQRNS

SEQ ID NO: 37758 - protein, 10 aa, Artificial Sequence
  Description of Artificial Sequence: Synthetic peptide
  Seed: KRILVNLSMV (KKLC1_HUMAN)
KRILVNLSMA

SEQ ID NO: 37759 - protein, 10 aa, Artificial Sequence
  Description of Artificial Sequence: Synthetic peptide
  Seed: LEHTLLSKGF (KKLC1_HUMAN)
LEHTLLSKGW

SEQ ID NO: 37760 - protein, 9 aa, Artificial Sequence
  Description of Artificial Sequence: Synthetic peptide
  Seed: KGFRGASPH (KKLC1_HUMAN)
KLFRGASPL

SEQ ID NO: 37761 - protein, 9 aa, Artificial Sequence
  Description of Artificial Sequence: Synthetic peptide
  Seed: ILNNFPHSI (KKLC1_HUMAN)
IYNNFPHSY

SEQ ID NO: 37762 - protein, 10 aa, Artificial Sequence
  Description of Artificial Sequence: Synthetic peptide
  Seed: EHTLLSKGFR (KKLC1_HUMAN)
EYTLLSKGFR

SEQ ID NO: 37763 - protein, 9 aa, Artificial Sequence
  Description of Artificial Sequence: Synthetic peptide
  Seed: RQKRILVNL (KKLC1_HUMAN)
RSKRILVNY

SEQ ID NO: 37764 - protein, 9 aa, Artificial Sequence
  Description of Artificial Sequence: Synthetic peptide
  Seed: KGFRGASPH (KKLC1_HUMAN)
KQFRGASPT

SEQ ID NO: 37765 - protein, 9 aa, Artificial Sequence
  Description of Artificial Sequence: Synthetic peptide
  Seed: KLVELEHTL (KKLC1_HUMAN)
KTVELEHTR

SEQ ID NO: 37766 - protein, 9 aa, Artificial Sequence
  Description of Artificial Sequence: Synthetic peptide
  Seed: LLSKGFRGA (KKLC1_HUMAN)
LQSKGFRGV

SEQ ID NO: 37767 - protein, 9 aa, Artificial Sequence
  Description of Artificial Sequence: Synthetic peptide
  Seed: NNFPHSIAR (KKLC1_HUMAN)
NIFPHSIAF

SEQ ID NO: 37768 - protein, 9 aa, Artificial Sequence
  Description of Artificial Sequence: Synthetic peptide
  Seed: KLVELEHTL (KKLC1_HUMAN)
KTVELEHTL

SEQ ID NO: 37769 - protein, 9 aa, Artificial Sequence
  Description of Artificial Sequence: Synthetic peptide
  Seed: KYRRFQRNT (KKLC1_HUMAN)
KYRRFQRNL

SEQ ID NO: 37770 - protein, 11 aa, Artificial Sequence
  Description of Artificial Sequence: Synthetic peptide
  Seed: YLLLASSILCA (KKLC1_HUMAN)
YNLLASSILCL

SEQ ID NO: 37771 - protein, 11 aa, Artificial Sequence
  Description of Artificial Sequence: Synthetic peptide
  Seed: KGFRGASPHRK (KKLC1_HUMAN)
KLFRGASPHRK

SEQ ID NO: 37772 - protein, 9 aa, Artificial Sequence
  Description of Artificial Sequence: Synthetic peptide
  Seed: SNTDNNLAV (KKLC1_HUMAN)
SMTDNNLAL

SEQ ID NO: 37773 - protein, 9 aa, Artificial Sequence
  Description of Artificial Sequence: Synthetic peptide
  Seed: RQKRILVNL (KKLC1_HUMAN)
RRKRILVNV

SEQ ID NO: 37774 - protein, 9 aa, Artificial Sequence
  Description of Artificial Sequence: Synthetic peptide
  Seed: YLLLASSIL (KKLC1_HUMAN)
YNLLASSIF

SEQ ID NO: 37775 - protein, 10 aa, Artificial Sequence
  Description of Artificial Sequence: Synthetic peptide
  Seed: SMVENKLVEL (KKLC1_HUMAN)
SMVENKLVER

SEQ ID NO: 37776 - protein, 10 aa, Artificial Sequence
  Description of Artificial Sequence: Synthetic peptide
  Seed: KRILVNLSMV (KKLC1_HUMAN)
KIILVNLSMV

SEQ ID NO: 37777 - protein, 10 aa, Artificial Sequence
  Description of Artificial Sequence: Synthetic peptide
  Seed: MSSNSTALAL (KKLC1_HUMAN)
MMSNSTALAL

SEQ ID NO: 37778 - protein, 10 aa, Artificial Sequence
  Description of Artificial Sequence: Synthetic peptide
  Seed: VFWKYRRFQR (KKLC1_HUMAN)
VMWKYRRFQR

SEQ ID NO: 37779 - protein, 11 aa, Artificial Sequence
  Description of Artificial Sequence: Synthetic peptide
  Seed: YLLLASSILCA (KKLC1_HUMAN)
YLLLASSILCV

SEQ ID NO: 37780 - protein, 9 aa, Artificial Sequence
  Description of Artificial Sequence: Synthetic peptide
  Seed: RILVNLSMV (KKLC1_HUMAN)
RTLVNLSMK

SEQ ID NO: 37781 - protein, 11 aa, Artificial Sequence
  Description of Artificial Sequence: Synthetic peptide
  Seed: YLLLASSILCA (KKLC1_HUMAN)
YQLLASSILCI

SEQ ID NO: 37782 - protein, 10 aa, Artificial Sequence
  Description of Artificial Sequence: Synthetic peptide
  Seed: YLLLASSILC (KKLC1_HUMAN)
YQLLASSILL

SEQ ID NO: 37783 - protein, 9 aa, Artificial Sequence
  Description of Artificial Sequence: Synthetic peptide
  Seed: LIVFWKYRR (KKLC1_HUMAN)
LSVFWKYRR

SEQ ID NO: 37784 - protein, 10 aa, Artificial Sequence
  Description of Artificial Sequence: Synthetic peptide
  Seed: YLLLASSILC (KKLC1_HUMAN)
YCLLASSILI

SEQ ID NO: 37785 - protein, 10 aa, Artificial Sequence
  Description of Artificial Sequence: Synthetic peptide
  Seed: KLVELEHTLL (KKLC1_HUMAN)
KVVELEHTLR

SEQ ID NO: 37786 - protein, 9 aa, Artificial Sequence
  Description of Artificial Sequence: Synthetic peptide
  Seed: RQKRILVNL (KKLC1_HUMAN)
RIKRILVNF

SEQ ID NO: 37787 - protein, 11 aa, Artificial Sequence
  Description of Artificial Sequence: Synthetic peptide
  Seed: MNFYLLLASSI (KKLC1_HUMAN)
MVFYLLLASSF

SEQ ID NO: 37788 - protein, 9 aa, Artificial Sequence
  Description of Artificial Sequence: Synthetic peptide
  Seed: YLLLASSIL (KKLC1_HUMAN)
YLLLASSIA

SEQ ID NO: 37789 - protein, 9 aa, Artificial Sequence
  Description of Artificial Sequence: Synthetic peptide
  Seed: LIVFWKYRR (KKLC1_HUMAN)
LFVFWKYRR

SEQ ID NO: 37790 - protein, 9 aa, Artificial Sequence
  Description of Artificial Sequence: Synthetic peptide
  Seed: HTLLSKGFR (KKLC1_HUMAN)
HQLLSKGFR

SEQ ID NO: 37791 - protein, 9 aa, Artificial Sequence
  Description of Artificial Sequence: Synthetic peptide
  Seed: NNFPHSIAR (KKLC1_HUMAN)
NFFPHSIAY

SEQ ID NO: 37792 - protein, 11 aa, Artificial Sequence
  Description of Artificial Sequence: Synthetic peptide
  Seed: LSMVENKLVEL (KKLC1_HUMAN)
LIMVENKLVEV

SEQ ID NO: 37793 - protein, 11 aa, Artificial Sequence
  Description of Artificial Sequence: Synthetic peptide
  Seed: RQKRILVNLSM (KKLC1_HUMAN)
RIKRILVNLSM

SEQ ID NO: 37794 - protein, 9 aa, Artificial Sequence
  Description of Artificial Sequence: Synthetic peptide
  Seed: KLVELEHTL (KKLC1_HUMAN)
KRVELEHTM

SEQ ID NO: 37795 - protein, 10 aa, Artificial Sequence
  Description of Artificial Sequence: Synthetic peptide
  Seed: SNSTALALVR (KKLC1_HUMAN)
SVSTALALVR

SEQ ID NO: 37796 - protein, 10 aa, Artificial Sequence
  Description of Artificial Sequence: Synthetic peptide
  Seed: YLLLASSILC (KKLC1_HUMAN)
YYLLASSILL

SEQ ID NO: 37797 - protein, 10 aa, Artificial Sequence
  Description of Artificial Sequence: Synthetic peptide
  Seed: SNTDNNLAVY (KKLC1_HUMAN)
SITDNNLAVY

SEQ ID NO: 37798 - protein, 9 aa, Artificial Sequence
  Description of Artificial Sequence: Synthetic peptide
  Seed: LVRPSSSGL (KKLC1_HUMAN)
LQRPSSSGF

SEQ ID NO: 37799 - protein, 9 aa, Artificial Sequence
  Description of Artificial Sequence: Synthetic peptide
  Seed: KLVELEHTL (KKLC1_HUMAN)
KLVELEHTI

SEQ ID NO: 37800 - protein, 10 aa, Artificial Sequence
  Description of Artificial Sequence: Synthetic peptide
  Seed: SMVENKLVEL (KKLC1_HUMAN)
SSVENKLVEY

SEQ ID NO: 37801 - protein, 10 aa, Artificial Sequence
  Description of Artificial Sequence: Synthetic peptide
  Seed: MSSNSTALAL (KKLC1_HUMAN)
MQSNSTALAF

SEQ ID NO: 37802 - protein, 9 aa, Artificial Sequence
  Description of Artificial Sequence: Synthetic peptide
  Seed: NLAVYDLSR (KKLC1_HUMAN)
NVAVYDLSK

SEQ ID NO: 37803 - protein, 9 aa, Artificial Sequence
  Description of Artificial Sequence: Synthetic peptide
  Seed: MVENKLVEL (KKLC1_HUMAN)
MRENKLVEM

SEQ ID NO: 37804 - protein, 9 aa, Artificial Sequence
  Description of Artificial Sequence: Synthetic peptide
  Seed: RQKRILVNL (KKLC1_HUMAN)
RSKRILVNW

SEQ ID NO: 37805 - protein, 10 aa, Artificial Sequence
  Description of Artificial Sequence: Synthetic peptide
  Seed: DILNNFPHSI (KKLC1_HUMAN)
DMLNNFPHSI

SEQ ID NO: 37806 - protein, 9 aa, Artificial Sequence
  Description of Artificial Sequence: Synthetic peptide
  Seed: YLLLASSIL (KKLC1_HUMAN)
YFLLASSIF

SEQ ID NO: 37807 - protein, 9 aa, Artificial Sequence
  Description of Artificial Sequence: Synthetic peptide
  Seed: YLLLASSIL (KKLC1_HUMAN)
YYLLASSIV

SEQ ID NO: 37808 - protein, 9 aa, Artificial Sequence
  Description of Artificial Sequence: Synthetic peptide
  Seed: ILNNFPHSI (KKLC1_HUMAN)
IANNFPHSH

SEQ ID NO: 37809 - protein, 9 aa, Artificial Sequence
  Description of Artificial Sequence: Synthetic peptide
  Seed: KLVELEHTL (KKLC1_HUMAN)
KMVELEHTK

SEQ ID NO: 37810 - protein, 10 aa, Artificial Sequence
  Description of Artificial Sequence: Synthetic peptide
  Seed: LASSILCALI (KKLC1_HUMAN)
LMSSILCALA

SEQ ID NO: 37811 - protein, 10 aa, Artificial Sequence
  Description of Artificial Sequence: Synthetic peptide
  Seed: VFWKYRRFQR (KKLC1_HUMAN)
VSWKYRRFQR

SEQ ID NO: 37812 - protein, 10 aa, Artificial Sequence
  Description of Artificial Sequence: Synthetic peptide
  Seed: YLLLASSILC (KKLC1_HUMAN)
YVLLASSILV

SEQ ID NO: 37813 - protein, 9 aa, Artificial Sequence
  Description of Artificial Sequence: Synthetic peptide
  Seed: FWKYRRFQR (KKLC1_HUMAN)
FAKYRRFQR

SEQ ID NO: 37814 - protein, 9 aa, Artificial Sequence
  Description of Artificial Sequence: Synthetic peptide
  Seed: KGFRGASPH (KKLC1_HUMAN)
KAFRGASPL

SEQ ID NO: 37815 - protein, 11 aa, Artificial Sequence
  Description of Artificial Sequence: Synthetic peptide
  Seed: LLLASSILCAL (KKLC1_HUMAN)
LMLASSILCAI

SEQ ID NO: 37816 - protein, 11 aa, Artificial Sequence
  Description of Artificial Sequence: Synthetic peptide
  Seed: LVELEHTLLSK (KKLC1_HUMAN)
LTELEHTLLSY

SEQ ID NO: 37817 - protein, 10 aa, Artificial Sequence
  Description of Artificial Sequence: Synthetic peptide
  Seed: LLASSILCAL (KKLC1_HUMAN)
LLASSILCAI

SEQ ID NO: 37818 - protein, 10 aa, Artificial Sequence
  Description of Artificial Sequence: Synthetic peptide
  Seed: LLLASSILCA (KKLC1_HUMAN)
LLLASSILCI

SEQ ID NO: 37819 - protein, 9 aa, Artificial Sequence
  Description of Artificial Sequence: Synthetic peptide
  Seed: RQKRILVNL (KKLC1_HUMAN)
RYKRILVNI

SEQ ID NO: 37820 - protein, 10 aa, Artificial Sequence
  Description of Artificial Sequence: Synthetic peptide
  Seed: SMVENKLVEL (KKLC1_HUMAN)
STVENKLVEY

SEQ ID NO: 37821 - protein, 8 aa, Artificial Sequence
  Description of Artificial Sequence: Synthetic peptide
  Seed: VYDLSRDI (KKLC1_HUMAN)
VIDLSRDM

SEQ ID NO: 37822 - protein, 10 aa, Artificial Sequence
  Description of Artificial Sequence: Synthetic peptide
  Seed: LASSILCALI (KKLC1_HUMAN)
LLSSILCALG

SEQ ID NO: 37823 - protein, 10 aa, Artificial Sequence
  Description of Artificial Sequence: Synthetic peptide
  Seed: MSSNSTALAL (KKLC1_HUMAN)
MASNSTALAV

SEQ ID NO: 37824 - protein, 10 aa, Artificial Sequence
  Description of Artificial Sequence: Synthetic peptide
  Seed: SSNSTALALV (KKLC1_HUMAN)
SMNSTALALM

SEQ ID NO: 37825 - protein, 9 aa, Artificial Sequence
  Description of Artificial Sequence: Synthetic peptide
  Seed: LSMVENKLV (KKLC1_HUMAN)
LSMVENKLW

SEQ ID NO: 37826 - protein, 10 aa, Artificial Sequence
  Description of Artificial Sequence: Synthetic peptide
  Seed: YLLLASSILC (KKLC1_HUMAN)
YELLASSILA

SEQ ID NO: 37827 - protein, 10 aa, Artificial Sequence
  Description of Artificial Sequence: Synthetic peptide
  Seed: KRILVNLSMV (KKLC1_HUMAN)
KMILVNLSML

SEQ ID NO: 37828 - protein, 9 aa, Artificial Sequence
  Description of Artificial Sequence: Synthetic peptide
  Seed: VYDLSRDIL (KKLC1_HUMAN)
VIDLSRDIL

SEQ ID NO: 37829 - protein, 9 aa, Artificial Sequence
  Description of Artificial Sequence: Synthetic peptide
  Seed: GASPHRKST (KKLC1_HUMAN)
GASPHRKSY

SEQ ID NO: 37830 - protein, 9 aa, Artificial Sequence
  Description of Artificial Sequence: Synthetic peptide
  Seed: NNFPHSIAR (KKLC1_HUMAN)
NRFPHSIAV

SEQ ID NO: 37831 - protein, 9 aa, Artificial Sequence
  Description of Artificial Sequence: Synthetic peptide
  Seed: KYRRFQRNT (KKLC1_HUMAN)
KIRRFQRNS

SEQ ID NO: 37832 - protein, 10 aa, Artificial Sequence
  Description of Artificial Sequence: Synthetic peptide
  Seed: SKGFRGASPH (KKLC1_HUMAN)
SMGFRGASPM

SEQ ID NO: 37833 - protein, 9 aa, Artificial Sequence
  Description of Artificial Sequence: Synthetic peptide
  Seed: ELEHTLLSK (KKLC1_HUMAN)
EAEHTLLSR

SEQ ID NO: 37834 - protein, 10 aa, Artificial Sequence
  Description of Artificial Sequence: Synthetic peptide
  Seed: LASSILCALI (KKLC1_HUMAN)
LMSSILCALF

SEQ ID NO: 37835 - protein, 9 aa, Artificial Sequence
  Description of Artificial Sequence: Synthetic peptide
  Seed: KYRRFQRNT (KKLC1_HUMAN)
KWRRFQRNA

SEQ ID NO: 37836 - protein, 11 aa, Artificial Sequence
  Description of Artificial Sequence: Synthetic peptide
  Seed: RQKRILVNLSM (KKLC1_HUMAN)
RNKRILVNLSL

SEQ ID NO: 37837 - protein, 9 aa, Artificial Sequence
  Description of Artificial Sequence: Synthetic peptide
  Seed: SSNSTALAL (KKLC1_HUMAN)
STNSTALAW

SEQ ID NO: 37838 - protein, 10 aa, Artificial Sequence
  Description of Artificial Sequence: Synthetic peptide
  Seed: MSSNSTALAL (KKLC1_HUMAN)
MISNSTALAI

SEQ ID NO: 37839 - protein, 9 aa, Artificial Sequence
  Description of Artificial Sequence: Synthetic peptide
  Seed: SNTDNNLAV (KKLC1_HUMAN)
SITDNNLAL

SEQ ID NO: 37840 - protein, 9 aa, Artificial Sequence
  Description of Artificial Sequence: Synthetic peptide
  Seed: LASSILCAL (KKLC1_HUMAN)
LLSSILCAF

SEQ ID NO: 37841 - protein, 9 aa, Artificial Sequence
  Description of Artificial Sequence: Synthetic peptide
  Seed: YLLLASSIL (KKLC1_HUMAN)
YVLLASSIF

SEQ ID NO: 37842 - protein, 9 aa, Artificial Sequence
  Description of Artificial Sequence: Synthetic peptide
  Seed: LSRDILNNF (KKLC1_HUMAN)
LQRDILNNY

SEQ ID NO: 37843 - protein, 11 aa, Artificial Sequence
  Description of Artificial Sequence: Synthetic peptide
  Seed: YLLLASSILCA (KKLC1_HUMAN)
YALLASSILCL

SEQ ID NO: 37844 - protein, 9 aa, Artificial Sequence
  Description of Artificial Sequence: Synthetic peptide
  Seed: LVRPSSSGL (KKLC1_HUMAN)
LIRPSSSGL

SEQ ID NO: 37845 - protein, 9 aa, Artificial Sequence
  Description of Artificial Sequence: Synthetic peptide
  Seed: NNFPHSIAR (KKLC1_HUMAN)
NGFPHSIAK

SEQ ID NO: 37846 - protein, 9 aa, Artificial Sequence
  Description of Artificial Sequence: Synthetic peptide
  Seed: NLAVYDLSR (KKLC1_HUMAN)
NMAVYDLSR

SEQ ID NO: 37847 - protein, 10 aa, Artificial Sequence
  Description of Artificial Sequence: Synthetic peptide
  Seed: KGFRGASPHR (KKLC1_HUMAN)
KMFRGASPHR

SEQ ID NO: 37848 - protein, 9 aa, Artificial Sequence
  Description of Artificial Sequence: Synthetic peptide
  Seed: LASSILCAL (KKLC1_HUMAN)
LHSSILCAY

SEQ ID NO: 37849 - protein, 10 aa, Artificial Sequence
  Description of Artificial Sequence: Synthetic peptide
  Seed: QKRILVNLSM (KKLC1_HUMAN)
QERILVNLSF

SEQ ID NO: 37850 - protein, 10 aa, Artificial Sequence
  Description of Artificial Sequence: Synthetic peptide
  Seed: LLLASSILCA (KKLC1_HUMAN)
LSLASSILCL

SEQ ID NO: 37851 - protein, 9 aa, Artificial Sequence
  Description of Artificial Sequence: Synthetic peptide
  Seed: RQKRILVNL (KKLC1_HUMAN)
RSKRILVNR

SEQ ID NO: 37852 - protein, 9 aa, Artificial Sequence
  Description of Artificial Sequence: Synthetic peptide
  Seed: NNFPHSIAR (KKLC1_HUMAN)
NIFPHSIAR

SEQ ID NO: 37853 - protein, 9 aa, Artificial Sequence
  Description of Artificial Sequence: Synthetic peptide
  Seed: SILCALIVF (KKLC1_HUMAN)
SELCALIVF

SEQ ID NO: 37854 - protein, 9 aa, Artificial Sequence
  Description of Artificial Sequence: Synthetic peptide
  Seed: KYRRFQRNT (KKLC1_HUMAN)
KIRRFQRNA

SEQ ID NO: 37855 - protein, 10 aa, Artificial Sequence
  Description of Artificial Sequence: Synthetic peptide
  Seed: KGFRGASPHR (KKLC1_HUMAN)
KTFRGASPHS

SEQ ID NO: 37856 - protein, 10 aa, Artificial Sequence
  Description of Artificial Sequence: Synthetic peptide
  Seed: SNTDNNLAVY (KKLC1_HUMAN)
SWTDNNLAVY

SEQ ID NO: 37857 - protein, 9 aa, Artificial Sequence
  Description of Artificial Sequence: Synthetic peptide
  Seed: VYDLSRDIL (KKLC1_HUMAN)
VSDLSRDIF

SEQ ID NO: 37858 - protein, 9 aa, Artificial Sequence
  Description of Artificial Sequence: Synthetic peptide
  Seed: LVELEHTLL (KKLC1_HUMAN)
LYELEHTLL

SEQ ID NO: 37859 - protein, 11 aa, Artificial Sequence
  Description of Artificial Sequence: Synthetic peptide
  Seed: MSSNSTALALV (KKLC1_HUMAN)
MVSNSTALALV

SEQ ID NO: 37860 - protein, 9 aa, Artificial Sequence
  Description of Artificial Sequence: Synthetic peptide
  Seed: MSSNSTALA (KKLC1_HUMAN)
MASNSTALM

SEQ ID NO: 37861 - protein, 9 aa, Artificial Sequence
  Description of Artificial Sequence: Synthetic peptide
  Seed: GFRGASPHR (KKLC1_HUMAN)
GTRGASPHR

SEQ ID NO: 37862 - protein, 9 aa, Artificial Sequence
  Description of Artificial Sequence: Synthetic peptide
  Seed: KYRRFQRNT (KKLC1_HUMAN)
KYRRFQRNS

SEQ ID NO: 37863 - protein, 9 aa, Artificial Sequence
  Description of Artificial Sequence: Synthetic peptide
  Seed: ILNNFPHSI (KKLC1_HUMAN)
IFNNFPHSY

SEQ ID NO: 37864 - protein, 9 aa, Artificial Sequence
  Description of Artificial Sequence: Synthetic peptide
  Seed: KLVELEHTL (KKLC1_HUMAN)
KNVELEHTF

SEQ ID NO: 37865 - protein, 9 aa, Artificial Sequence
  Description of Artificial Sequence: Synthetic peptide
  Seed: YLLLASSIL (KKLC1_HUMAN)
YELLASSIY

SEQ ID NO: 37866 - protein, 9 aa, Artificial Sequence
  Description of Artificial Sequence: Synthetic peptide
  Seed: KGFRGASPH (KKLC1_HUMAN)
KMFRGASPI

SEQ ID NO: 37867 - protein, 9 aa, Artificial Sequence
  Description of Artificial Sequence: Synthetic peptide
  Seed: LSRDILNNF (KKLC1_HUMAN)
LSRDILNNM

SEQ ID NO: 37868 - protein, 9 aa, Artificial Sequence
  Description of Artificial Sequence: Synthetic peptide
  Seed: ILNNFPHSI (KKLC1_HUMAN)
ITNNFPHSF

SEQ ID NO: 37869 - protein, 10 aa, Artificial Sequence
  Description of Artificial Sequence: Synthetic peptide
  Seed: SNTDNNLAVY (KKLC1_HUMAN)
SHTDNNLAVY

SEQ ID NO: 37870 - protein, 8 aa, Artificial Sequence
  Description of Artificial Sequence: Synthetic peptide
  Seed: NTDNNLAV (KKLC1_HUMAN)
NTDNNLAM

SEQ ID NO: 37871 - protein, 9 aa, Artificial Sequence
  Description of Artificial Sequence: Synthetic peptide
  Seed: KYRRFQRNT (KKLC1_HUMAN)
KTRRFQRNM

SEQ ID NO: 37872 - protein, 9 aa, Artificial Sequence
  Description of Artificial Sequence: Synthetic peptide
  Seed: AVYDLSRDI (KKLC1_HUMAN)
AAYDLSRDY

SEQ ID NO: 37873 - protein, 11 aa, Artificial Sequence
  Description of Artificial Sequence: Synthetic peptide
  Seed: YLLLASSILCA (KKLC1_HUMAN)
YDLLASSILCI

SEQ ID NO: 37874 - protein, 10 aa, Artificial Sequence
  Description of Artificial Sequence: Synthetic peptide
  Seed: LLLASSILCA (KKLC1_HUMAN)
LLLASSILCV

SEQ ID NO: 37875 - protein, 9 aa, Artificial Sequence
  Description of Artificial Sequence: Synthetic peptide
  Seed: LVRPSSSGL (KKLC1_HUMAN)
LFRPSSSGK

SEQ ID NO: 37876 - protein, 9 aa, Artificial Sequence
  Description of Artificial Sequence: Synthetic peptide
  Seed: NNFPHSIAR (KKLC1_HUMAN)
NSFPHSIAR

SEQ ID NO: 37877 - protein, 10 aa, Artificial Sequence
  Description of Artificial Sequence: Synthetic peptide
  Seed: KYRRFQRNTG (KKLC1_HUMAN)
KARRFQRNTA

SEQ ID NO: 37878 - protein, 9 aa, Artificial Sequence
  Description of Artificial Sequence: Synthetic peptide
  Seed: ILNNFPHSI (KKLC1_HUMAN)
ISNNFPHSM

SEQ ID NO: 37879 - protein, 9 aa, Artificial Sequence
  Description of Artificial Sequence: Synthetic peptide
  Seed: ILNNFPHSI (KKLC1_HUMAN)
IQNNFPHSW

SEQ ID NO: 37880 - protein, 9 aa, Artificial Sequence
  Description of Artificial Sequence: Synthetic peptide
  Seed: RQKRILVNL (KKLC1_HUMAN)
RVKRILVNG

SEQ ID NO: 37881 - protein, 10 aa, Artificial Sequence
  Description of Artificial Sequence: Synthetic peptide
  Seed: SMVENKLVEL (KKLC1_HUMAN)
SIVENKLVEY

SEQ ID NO: 37882 - protein, 8 aa, Artificial Sequence
  Description of Artificial Sequence: Synthetic peptide
  Seed: YLLLASSI (KKLC1_HUMAN)
YQLLASSV

SEQ ID NO: 37883 - protein, 10 aa, Artificial Sequence
  Description of Artificial Sequence: Synthetic peptide
  Seed: MSSNSTALAL (KKLC1_HUMAN)
MISNSTALAM

SEQ ID NO: 37884 - protein, 9 aa, Artificial Sequence
  Description of Artificial Sequence: Synthetic peptide
  Seed: LASSILCAL (KKLC1_HUMAN)
LTSSILCAI

SEQ ID NO: 37885 - protein, 9 aa, Artificial Sequence
  Description of Artificial Sequence: Synthetic peptide
  Seed: KRILVNLSM (KKLC1_HUMAN)
KRILVNLSL

SEQ ID NO: 37886 - protein, 10 aa, Artificial Sequence
  Description of Artificial Sequence: Synthetic peptide
  Seed: MSSNSTALAL (KKLC1_HUMAN)
MISNSTALAW

SEQ ID NO: 37887 - protein, 11 aa, Artificial Sequence
  Description of Artificial Sequence: Synthetic peptide
  Seed: LLLASSILCAL (KKLC1_HUMAN)
LFLASSILCAA

SEQ ID NO: 37888 - protein, 9 aa, Artificial Sequence
  Description of Artificial Sequence: Synthetic peptide
  Seed: VNLSMVENK (KKLC1_HUMAN)
VMLSMVENR

SEQ ID NO: 37889 - protein, 9 aa, Artificial Sequence
  Description of Artificial Sequence: Synthetic peptide
  Seed: LASSILCAL (KKLC1_HUMAN)
LISSILCAF

SEQ ID NO: 37890 - protein, 10 aa, Artificial Sequence
  Description of Artificial Sequence: Synthetic peptide
  Seed: KGFRGASPHR (KKLC1_HUMAN)
KGFRGASPHK

SEQ ID NO: 37891 - protein, 9 aa, Artificial Sequence
  Description of Artificial Sequence: Synthetic peptide
  Seed: ILNNFPHSI (KKLC1_HUMAN)
IHNNFPHSM

SEQ ID NO: 37892 - protein, 10 aa, Artificial Sequence
  Description of Artificial Sequence: Synthetic peptide
  Seed: QKRILVNLSM (KKLC1_HUMAN)
QYRILVNLSL

SEQ ID NO: 37893 - protein, 9 aa, Artificial Sequence
  Description of Artificial Sequence: Synthetic peptide
  Seed: KRILVNLSM (KKLC1_HUMAN)
KRILVNLSK

SEQ ID NO: 37894 - protein, 10 aa, Artificial Sequence
  Description of Artificial Sequence: Synthetic peptide
  Seed: MSSNSTALAL (KKLC1_HUMAN)
MKSNSTALAL

SEQ ID NO: 37895 - protein, 10 aa, Artificial Sequence
  Description of Artificial Sequence: Synthetic peptide
  Seed: NFYLLLASSI (KKLC1_HUMAN)
NWYLLLASSF

SEQ ID NO: 37896 - protein, 10 aa, Artificial Sequence
  Description of Artificial Sequence: Synthetic peptide
  Seed: SMVENKLVEL (KKLC1_HUMAN)
SMVENKLVEA

SEQ ID NO: 37897 - protein, 9 aa, Artificial Sequence
  Description of Artificial Sequence: Synthetic peptide
  Seed: GFRGASPHR (KKLC1_HUMAN)
GQRGASPHK

SEQ ID NO: 37898 - protein, 10 aa, Artificial Sequence
  Description of Artificial Sequence: Synthetic peptide
  Seed: KYRRFQRNTG (KKLC1_HUMAN)
KIRRFQRNTA

SEQ ID NO: 37899 - protein, 10 aa, Artificial Sequence
  Description of Artificial Sequence: Synthetic peptide
  Seed: KGFRGASPHR (KKLC1_HUMAN)
KWFRGASPHA

SEQ ID NO: 37900 - protein, 9 aa, Artificial Sequence
  Description of Artificial Sequence: Synthetic peptide
  Seed: NNFPHSIAR (KKLC1_HUMAN)
NVFPHSIAM

SEQ ID NO: 37901 - protein, 9 aa, Artificial Sequence
  Description of Artificial Sequence: Synthetic peptide
  Seed: GASPHRKST (KKLC1_HUMAN)
GASPHRKSM

SEQ ID NO: 37902 - protein, 11 aa, Artificial Sequence
  Description of Artificial Sequence: Synthetic peptide
  Seed: LLLASSILCAL (KKLC1_HUMAN)
LYLASSILCAL

SEQ ID NO: 37903 - protein, 11 aa, Artificial Sequence
  Description of Artificial Sequence: Synthetic peptide
  Seed: RQKRILVNLSM (KKLC1_HUMAN)
RMKRILVNLSR

SEQ ID NO: 37904 - protein, 10 aa, Artificial Sequence
  Description of Artificial Sequence: Synthetic peptide
  Seed: FYLLLASSIL (KKLC1_HUMAN)
FFLLLASSIV

SEQ ID NO: 37905 - protein, 9 aa, Artificial Sequence
  Description of Artificial Sequence: Synthetic peptide
  Seed: LASSILCAL (KKLC1_HUMAN)
LQSSILCAL

SEQ ID NO: 37906 - protein, 10 aa, Artificial Sequence
  Description of Artificial Sequence: Synthetic peptide
  Seed: YLLLASSILC (KKLC1_HUMAN)
YVLLASSILA

SEQ ID NO: 37907 - protein, 9 aa, Artificial Sequence
  Description of Artificial Sequence: Synthetic peptide
  Seed: YLLLASSIL (KKLC1_HUMAN)
YKLLASSIM

SEQ ID NO: 37908 - protein, 10 aa, Artificial Sequence
  Description of Artificial Sequence: Synthetic peptide
  Seed: YLLLASSILC (KKLC1_HUMAN)
YFLLASSILL

SEQ ID NO: 37909 - protein, 10 aa, Artificial Sequence
  Description of Artificial Sequence: Synthetic peptide
  Seed: LLASSILCAL (KKLC1_HUMAN)
LVASSILCAM

SEQ ID NO: 37910 - protein, 8 aa, Artificial Sequence
  Description of Artificial Sequence: Synthetic peptide
  Seed: VYDLSRDI (KKLC1_HUMAN)
VTDLSRDM

SEQ ID NO: 37911 - protein, 10 aa, Artificial Sequence
  Description of Artificial Sequence: Synthetic peptide
  Seed: RQKRILVNLS (KKLC1_HUMAN)
RAKRILVNLK

SEQ ID NO: 37912 - protein, 9 aa, Artificial Sequence
  Description of Artificial Sequence: Synthetic peptide
  Seed: KGFRGASPH (KKLC1_HUMAN)
KQFRGASPA

SEQ ID NO: 37913 - protein, 9 aa, Artificial Sequence
  Description of Artificial Sequence: Synthetic peptide
  Seed: KRILVNLSM (KKLC1_HUMAN)
KMILVNLSM

SEQ ID NO: 37914 - protein, 10 aa, Artificial Sequence
  Description of Artificial Sequence: Synthetic peptide
  Seed: NKLVELEHTL (KKLC1_HUMAN)
NWLVELEHTV

SEQ ID NO: 37915 - protein, 9 aa, Artificial Sequence
  Description of Artificial Sequence: Synthetic peptide
  Seed: KGFRGASPH (KKLC1_HUMAN)
KIFRGASPM

SEQ ID NO: 37916 - protein, 10 aa, Artificial Sequence
  Description of Artificial Sequence: Synthetic peptide
  Seed: SMVENKLVEL (KKLC1_HUMAN)
SVVENKLVEV

SEQ ID NO: 37917 - protein, 10 aa, Artificial Sequence
  Description of Artificial Sequence: Synthetic peptide
  Seed: KGFRGASPHR (KKLC1_HUMAN)
KYFRGASPHA

SEQ ID NO: 37918 - protein, 10 aa, Artificial Sequence
  Description of Artificial Sequence: Synthetic peptide
  Seed: LLASSILCAL (KKLC1_HUMAN)
LVASSILCAA

SEQ ID NO: 37919 - protein, 8 aa, Artificial Sequence
  Description of Artificial Sequence: Synthetic peptide
  Seed: IVFWKYRR (KKLC1_HUMAN)
ITFWKYRR

SEQ ID NO: 37920 - protein, 10 aa, Artificial Sequence
  Description of Artificial Sequence: Synthetic peptide
  Seed: DILNNFPHSI (KKLC1_HUMAN)
DTLNNFPHSI

SEQ ID NO: 37921 - protein, 10 aa, Artificial Sequence
  Description of Artificial Sequence: Synthetic peptide
  Seed: MSSNSTALAL (KKLC1_HUMAN)
MTSNSTALAI

SEQ ID NO: 37922 - protein, 9 aa, Artificial Sequence
  Description of Artificial Sequence: Synthetic peptide
  Seed: RILVNLSMV (KKLC1_HUMAN)
RQLVNLSMI

SEQ ID NO: 37923 - protein, 10 aa, Artificial Sequence
  Description of Artificial Sequence: Synthetic peptide
  Seed: KYRRFQRNTG (KKLC1_HUMAN)
KIRRFQRNTV

SEQ ID NO: 37924 - protein, 9 aa, Artificial Sequence
  Description of Artificial Sequence: Synthetic peptide
  Seed: KGFRGASPH (KKLC1_HUMAN)
KRFRGASPY

SEQ ID NO: 37925 - protein, 9 aa, Artificial Sequence
  Description of Artificial Sequence: Synthetic peptide
  Seed: VYDLSRDIL (KKLC1_HUMAN)
VVDLSRDIF

SEQ ID NO: 37926 - protein, 9 aa, Artificial Sequence
  Description of Artificial Sequence: Synthetic peptide
  Seed: ILNNFPHSI (KKLC1_HUMAN)
ITNNFPHSV

SEQ ID NO: 37927 - protein, 11 aa, Artificial Sequence
  Description of Artificial Sequence: Synthetic peptide
  Seed: RDILNNFPHSI (KKLC1_HUMAN)
RMILNNFPHSL

SEQ ID NO: 37928 - protein, 9 aa, Artificial Sequence
  Description of Artificial Sequence: Synthetic peptide
  Seed: SSNSTALAL (KKLC1_HUMAN)
SQNSTALAL

SEQ ID NO: 37929 - protein, 9 aa, Artificial Sequence
  Description of Artificial Sequence: Synthetic peptide
  Seed: RQKRILVNL (KKLC1_HUMAN)
RTKRILVNN

SEQ ID NO: 37930 - protein, 9 aa, Artificial Sequence
  Description of Artificial Sequence: Synthetic peptide
  Seed: RQKRILVNL (KKLC1_HUMAN)
RVKRILVNP

SEQ ID NO: 37931 - protein, 10 aa, Artificial Sequence
  Description of Artificial Sequence: Synthetic peptide
  Seed: MSSNSTALAL (KKLC1_HUMAN)
MVSNSTALAL

SEQ ID NO: 37932 - protein, 10 aa, Artificial Sequence
  Description of Artificial Sequence: Synthetic peptide
  Seed: NKLVELEHTL (KKLC1_HUMAN)
NSLVELEHTV

SEQ ID NO: 37933 - protein, 10 aa, Artificial Sequence
  Description of Artificial Sequence: Synthetic peptide
  Seed: RRFQRNTGEM (KKLC1_HUMAN)
RMFQRNTGEF

SEQ ID NO: 37934 - protein, 8 aa, Artificial Sequence
  Description of Artificial Sequence: Synthetic peptide
  Seed: VYDLSRDI (KKLC1_HUMAN)
VGDLSRDL

SEQ ID NO: 37935 - protein, 9 aa, Artificial Sequence
  Description of Artificial Sequence: Synthetic peptide
  Seed: RQKRILVNL (KKLC1_HUMAN)
REKRILVNM

SEQ ID NO: 37936 - protein, 9 aa, Artificial Sequence
  Description of Artificial Sequence: Synthetic peptide
  Seed: RQKRILVNL (KKLC1_HUMAN)
RVKRILVNM

SEQ ID NO: 37937 - protein, 10 aa, Artificial Sequence
  Description of Artificial Sequence: Synthetic peptide
  Seed: QKRILVNLSM (KKLC1_HUMAN)
QDRILVNLSV

SEQ ID NO: 37938 - protein, 10 aa, Artificial Sequence
  Description of Artificial Sequence: Synthetic peptide
  Seed: NNLAVYDLSR (KKLC1_HUMAN)
NTLAVYDLSK

SEQ ID NO: 37939 - protein, 10 aa, Artificial Sequence
  Description of Artificial Sequence: Synthetic peptide
  Seed: GEMSSNSTAL (KKLC1_HUMAN)
GFMSSNSTAY

SEQ ID NO: 37940 - protein, 9 aa, Artificial Sequence
  Description of Artificial Sequence: Synthetic peptide
  Seed: EMSSNSTAL (KKLC1_HUMAN)
EHSSNSTAM

SEQ ID NO: 37941 - protein, 10 aa, Artificial Sequence
  Description of Artificial Sequence: Synthetic peptide
  Seed: LASSILCALI (KKLC1_HUMAN)
LLSSILCALL

SEQ ID NO: 37942 - protein, 9 aa, Artificial Sequence
  Description of Artificial Sequence: Synthetic peptide
  Seed: ILNNFPHSI (KKLC1_HUMAN)
IGNNFPHSM

SEQ ID NO: 37943 - protein, 9 aa, Artificial Sequence
  Description of Artificial Sequence: Synthetic peptide
  Seed: NTDNNLAVY (KKLC1_HUMAN)
NFDNNLAVM

SEQ ID NO: 37944 - protein, 9 aa, Artificial Sequence
  Description of Artificial Sequence: Synthetic peptide
  Seed: SSNSTALAL (KKLC1_HUMAN)
SPNSTALAA

SEQ ID NO: 37945 - protein, 11 aa, Artificial Sequence
  Description of Artificial Sequence: Synthetic peptide
  Seed: RQKRILVNLSM (KKLC1_HUMAN)
RPKRILVNLSL

SEQ ID NO: 37946 - protein, 9 aa, Artificial Sequence
  Description of Artificial Sequence: Synthetic peptide
  Seed: ASSILCALI (KKLC1_HUMAN)
AMSILCALV

SEQ ID NO: 37947 - protein, 9 aa, Artificial Sequence
  Description of Artificial Sequence: Synthetic peptide
  Seed: NNFPHSIAR (KKLC1_HUMAN)
NYFPHSIAL

SEQ ID NO: 37948 - protein, 9 aa, Artificial Sequence
  Description of Artificial Sequence: Synthetic peptide
  Seed: LASSILCAL (KKLC1_HUMAN)
LTSSILCAF

SEQ ID NO: 37949 - protein, 9 aa, Artificial Sequence
  Description of Artificial Sequence: Synthetic peptide
  Seed: SSNSTALAL (KKLC1_HUMAN)
SGNSTALAW

SEQ ID NO: 37950 - protein, 8 aa, Artificial Sequence
  Description of Artificial Sequence: Synthetic peptide
  Seed: VENKLVEL (KKLC1_HUMAN)
VQNKLVEI

SEQ ID NO: 37951 - protein, 9 aa, Artificial Sequence
  Description of Artificial Sequence: Synthetic peptide
  Seed: NTDNNLAVY (KKLC1_HUMAN)
NCDNNLAVL

SEQ ID NO: 37952 - protein, 10 aa, Artificial Sequence
  Description of Artificial Sequence: Synthetic peptide
  Seed: MSSNSTALAL (KKLC1_HUMAN)
MASNSTALAM

SEQ ID NO: 37953 - protein, 9 aa, Artificial Sequence
  Description of Artificial Sequence: Synthetic peptide
  Seed: KLVELEHTL (KKLC1_HUMAN)
KTVELEHTK

SEQ ID NO: 37954 - protein, 9 aa, Artificial Sequence
  Description of Artificial Sequence: Synthetic peptide
  Seed: VYDLSRDIL (KKLC1_HUMAN)
VIDLSRDIF

SEQ ID NO: 37955 - protein, 10 aa, Artificial Sequence
  Description of Artificial Sequence: Synthetic peptide
  Seed: TLLSKGFRGA (KKLC1_HUMAN)
TMLSKGFRGV

SEQ ID NO: 37956 - protein, 9 aa, Artificial Sequence
  Description of Artificial Sequence: Synthetic peptide
  Seed: GFRGASPHR (KKLC1_HUMAN)
GGRGASPHK

SEQ ID NO: 37957 - protein, 9 aa, Artificial Sequence
  Description of Artificial Sequence: Synthetic peptide
  Seed: FWKYRRFQR (KKLC1_HUMAN)
FFKYRRFQK

SEQ ID NO: 37958 - protein, 10 aa, Artificial Sequence
  Description of Artificial Sequence: Synthetic peptide
  Seed: GFRGASPHRK (KKLC1_HUMAN)
GSRGASPHRK

SEQ ID NO: 37959 - protein, 10 aa, Artificial Sequence
  Description of Artificial Sequence: Synthetic peptide
  Seed: TLLSKGFRGA (KKLC1_HUMAN)
TMLSKGFRGI

SEQ ID NO: 37960 - protein, 9 aa, Artificial Sequence
  Description of Artificial Sequence: Synthetic peptide
  Seed: HSIARQKRI (KKLC1_HUMAN)
HTIARQKRW

SEQ ID NO: 37961 - protein, 9 aa, Artificial Sequence
  Description of Artificial Sequence: Synthetic peptide
  Seed: VNLSMVENK (KKLC1_HUMAN)
VSLSMVENK

SEQ ID NO: 37962 - protein, 10 aa, Artificial Sequence
  Description of Artificial Sequence: Synthetic peptide
  Seed: NFYLLLASSI (KKLC1_HUMAN)
NTYLLLASSF

SEQ ID NO: 37963 - protein, 9 aa, Artificial Sequence
  Description of Artificial Sequence: Synthetic peptide
  Seed: MVENKLVEL (KKLC1_HUMAN)
MYENKLVEF

SEQ ID NO: 37964 - protein, 10 aa, Artificial Sequence
  Description of Artificial Sequence: Synthetic peptide
  Seed: RQKRILVNLS (KKLC1_HUMAN)
RIKRILVNLA

SEQ ID NO: 37965 - protein, 9 aa, Artificial Sequence
  Description of Artificial Sequence: Synthetic peptide
  Seed: MVENKLVEL (KKLC1_HUMAN)
MAENKLVEL

SEQ ID NO: 37966 - protein, 10 aa, Artificial Sequence
  Description of Artificial Sequence: Synthetic peptide
  Seed: MSSNSTALAL (KKLC1_HUMAN)
MHSNSTALAW

SEQ ID NO: 37967 - protein, 11 aa, Artificial Sequence
  Description of Artificial Sequence: Synthetic peptide
  Seed: LLASSILCALI (KKLC1_HUMAN)
LMASSILCALA

SEQ ID NO: 37968 - protein, 9 aa, Artificial Sequence
  Description of Artificial Sequence: Synthetic peptide
  Seed: NNFPHSIAR (KKLC1_HUMAN)
NAFPHSIAL

SEQ ID NO: 37969 - protein, 10 aa, Artificial Sequence
  Description of Artificial Sequence: Synthetic peptide
  Seed: VELEHTLLSK (KKLC1_HUMAN)
VALEHTLLSK

SEQ ID NO: 37970 - protein, 9 aa, Artificial Sequence
  Description of Artificial Sequence: Synthetic peptide
  Seed: KGFRGASPH (KKLC1_HUMAN)
KQFRGASPG

SEQ ID NO: 37971 - protein, 9 aa, Artificial Sequence
  Description of Artificial Sequence: Synthetic peptide
  Seed: LSRDILNNF (KKLC1_HUMAN)
LMRDILNNY

SEQ ID NO: 37972 - protein, 9 aa, Artificial Sequence
  Description of Artificial Sequence: Synthetic peptide
  Seed: VYDLSRDIL (KKLC1_HUMAN)
VFDLSRDIF

SEQ ID NO: 37973 - protein, 10 aa, Artificial Sequence
  Description of Artificial Sequence: Synthetic peptide
  Seed: ALVRPSSSGL (KKLC1_HUMAN)
AVVRPSSSGK

SEQ ID NO: 37974 - protein, 10 aa, Artificial Sequence
  Description of Artificial Sequence: Synthetic peptide
  Seed: QKRILVNLSM (KKLC1_HUMAN)
QARILVNLSF

SEQ ID NO: 37975 - protein, 10 aa, Artificial Sequence
  Description of Artificial Sequence: Synthetic peptide
  Seed: QKRILVNLSM (KKLC1_HUMAN)
QGRILVNLSF

SEQ ID NO: 37976 - protein, 9 aa, Artificial Sequence
  Description of Artificial Sequence: Synthetic peptide
  Seed: AVYDLSRDI (KKLC1_HUMAN)
AAYDLSRDM

SEQ ID NO: 37977 - protein, 9 aa, Artificial Sequence
  Description of Artificial Sequence: Synthetic peptide
  Seed: RQKRILVNL (KKLC1_HUMAN)
REKRILVNV

SEQ ID NO: 37978 - protein, 9 aa, Artificial Sequence
  Description of Artificial Sequence: Synthetic peptide
  Seed: NNFPHSIAR (KKLC1_HUMAN)
NQFPHSIAL

SEQ ID NO: 37979 - protein, 9 aa, Artificial Sequence
  Description of Artificial Sequence: Synthetic peptide
  Seed: KLVELEHTL (KKLC1_HUMAN)
KMVELEHTA

SEQ ID NO: 37980 - protein, 9 aa, Artificial Sequence
  Description of Artificial Sequence: Synthetic peptide
  Seed: MSSNSTALA (KKLC1_HUMAN)
MQSNSTALL

SEQ ID NO: 37981 - protein, 9 aa, Artificial Sequence
  Description of Artificial Sequence: Synthetic peptide
  Seed: KRILVNLSM (KKLC1_HUMAN)
KEILVNLSY

SEQ ID NO: 37982 - protein, 9 aa, Artificial Sequence
  Description of Artificial Sequence: Synthetic peptide
  Seed: RILVNLSMV (KKLC1_HUMAN)
RMLVNLSMI

SEQ ID NO: 37983 - protein, 11 aa, Artificial Sequence
  Description of Artificial Sequence: Synthetic peptide
  Seed: YLLLASSILCA (KKLC1_HUMAN)
YQLLASSILCL

SEQ ID NO: 37984 - protein, 9 aa, Artificial Sequence
  Description of Artificial Sequence: Synthetic peptide
  Seed: NTDNNLAVY (KKLC1_HUMAN)
NLDNNLAVY

SEQ ID NO: 37985 - protein, 9 aa, Artificial Sequence
  Description of Artificial Sequence: Synthetic peptide
  Seed: NTDNNLAVY (KKLC1_HUMAN)
NVDNNLAVL

SEQ ID NO: 37986 - protein, 9 aa, Artificial Sequence
  Description of Artificial Sequence: Synthetic peptide
  Seed: SNTDNNLAV (KKLC1_HUMAN)
SATDNNLAM

SEQ ID NO: 37987 - protein, 8 aa, Artificial Sequence
  Description of Artificial Sequence: Synthetic peptide
  Seed: VYDLSRDI (KKLC1_HUMAN)
VADLSRDI

SEQ ID NO: 37988 - protein, 10 aa, Artificial Sequence
  Description of Artificial Sequence: Synthetic peptide
  Seed: GEMSSNSTAL (KKLC1_HUMAN)
GKMSSNSTAV

SEQ ID NO: 37989 - protein, 10 aa, Artificial Sequence
  Description of Artificial Sequence: Synthetic peptide
  Seed: KRILVNLSMV (KKLC1_HUMAN)
KLILVNLSMI

SEQ ID NO: 37990 - protein, 11 aa, Artificial Sequence
  Description of Artificial Sequence: Synthetic peptide
  Seed: RQKRILVNLSM (KKLC1_HUMAN)
RKKRILVNLSK

SEQ ID NO: 37991 - protein, 9 aa, Artificial Sequence
  Description of Artificial Sequence: Synthetic peptide
  Seed: RQKRILVNL (KKLC1_HUMAN)
RLKRILVNY

SEQ ID NO: 37992 - protein, 9 aa, Artificial Sequence
  Description of Artificial Sequence: Synthetic peptide
  Seed: NNFPHSIAR (KKLC1_HUMAN)
NGFPHSIAL

SEQ ID NO: 37993 - protein, 10 aa, Artificial Sequence
  Description of Artificial Sequence: Synthetic peptide
  Seed: KGFRGASPHR (KKLC1_HUMAN)
KMFRGASPHV

SEQ ID NO: 37994 - protein, 9 aa, Artificial Sequence
  Description of Artificial Sequence: Synthetic peptide
  Seed: MVENKLVEL (KKLC1_HUMAN)
MEENKLVEV

SEQ ID NO: 37995 - protein, 9 aa, Artificial Sequence
  Description of Artificial Sequence: Synthetic peptide
  Seed: VYDLSRDIL (KKLC1_HUMAN)
VWDLSRDIM

SEQ ID NO: 37996 - protein, 8 aa, Artificial Sequence
  Description of Artificial Sequence: Synthetic peptide
  Seed: NTDNNLAV (KKLC1_HUMAN)
NADNNLAL

SEQ ID NO: 37997 - protein, 10 aa, Artificial Sequence
  Description of Artificial Sequence: Synthetic peptide
  Seed: YLLLASSILC (KKLC1_HUMAN)
YALLASSILV

SEQ ID NO: 37998 - protein, 9 aa, Artificial Sequence
  Description of Artificial Sequence: Synthetic peptide
  Seed: YLLLASSIL (KKLC1_HUMAN)
YELLASSIF

SEQ ID NO: 37999 - protein, 9 aa, Artificial Sequence
  Description of Artificial Sequence: Synthetic peptide
  Seed: MSSNSTALA (KKLC1_HUMAN)
MASNSTALY

SEQ ID NO: 38000 - protein, 9 aa, Artificial Sequence
  Description of Artificial Sequence: Synthetic peptide
  Seed: MSSNSTALA (KKLC1_HUMAN)
MISNSTALF

SEQ ID NO: 38001 - protein, 10 aa, Artificial Sequence
  Description of Artificial Sequence: Synthetic peptide
  Seed: LLASSILCAL (KKLC1_HUMAN)
LLASSILCAT

SEQ ID NO: 38002 - protein, 10 aa, Artificial Sequence
  Description of Artificial Sequence: Synthetic peptide
  Seed: EMSSNSTALA (KKLC1_HUMAN)
ERSSNSTALV

SEQ ID NO: 38003 - protein, 10 aa, Artificial Sequence
  Description of Artificial Sequence: Synthetic peptide
  Seed: LASSILCALI (KKLC1_HUMAN)
LLSSILCALA

SEQ ID NO: 38004 - protein, 8 aa, Artificial Sequence
  Description of Artificial Sequence: Synthetic peptide
  Seed: VENKLVEL (KKLC1_HUMAN)
VENKLVEY

SEQ ID NO: 38005 - protein, 11 aa, Artificial Sequence
  Description of Artificial Sequence: Synthetic peptide
  Seed: NNFPHSIARQK (KKLC1_HUMAN)
NTFPHSIARQK

SEQ ID NO: 38006 - protein, 9 aa, Artificial Sequence
  Description of Artificial Sequence: Synthetic peptide
  Seed: KGFRGASPH (KKLC1_HUMAN)
KQFRGASPL

SEQ ID NO: 38007 - protein, 9 aa, Artificial Sequence
  Description of Artificial Sequence: Synthetic peptide
  Seed: ILCALIVFW (KKLC1_HUMAN)
ISCALIVFW

SEQ ID NO: 38008 - protein, 9 aa, Artificial Sequence
  Description of Artificial Sequence: Synthetic peptide
  Seed: SILCALIVF (KKLC1_HUMAN)
STLCALIVY

SEQ ID NO: 38009 - protein, 9 aa, Artificial Sequence
  Description of Artificial Sequence: Synthetic peptide
  Seed: HTLLSKGFR (KKLC1_HUMAN)
HYLLSKGFR

SEQ ID NO: 38010 - protein, 9 aa, Artificial Sequence
  Description of Artificial Sequence: Synthetic peptide
  Seed: KRILVNLSM (KKLC1_HUMAN)
KKILVNLSY

SEQ ID NO: 38011 - protein, 11 aa, Artificial Sequence
  Description of Artificial Sequence: Synthetic peptide
  Seed: RRFQRNTGEMS (KKLC1_HUMAN)
RRFQRNTGEMI

SEQ ID NO: 38012 - protein, 9 aa, Artificial Sequence
  Description of Artificial Sequence: Synthetic peptide
  Seed: RILVNLSMV (KKLC1_HUMAN)
RLLVNLSMM

SEQ ID NO: 38013 - protein, 9 aa, Artificial Sequence
  Description of Artificial Sequence: Synthetic peptide
  Seed: RQKRILVNL (KKLC1_HUMAN)
RVKRILVNS

SEQ ID NO: 38014 - protein, 10 aa, Artificial Sequence
  Description of Artificial Sequence: Synthetic peptide
  Seed: KYRRFQRNTG (KKLC1_HUMAN)
KYRRFQRNTV

SEQ ID NO: 38015 - protein, 10 aa, Artificial Sequence
  Description of Artificial Sequence: Synthetic peptide
  Seed: QKRILVNLSM (KKLC1_HUMAN)
QIRILVNLSL

SEQ ID NO: 38016 - protein, 11 aa, Artificial Sequence
  Description of Artificial Sequence: Synthetic peptide
  Seed: RQKRILVNLSM (KKLC1_HUMAN)
RIKRILVNLSI

SEQ ID NO: 38017 - protein, 9 aa, Artificial Sequence
  Description of Artificial Sequence: Synthetic peptide
  Seed: SNTDNNLAV (KKLC1_HUMAN)
SITDNNLAM

SEQ ID NO: 38018 - protein, 10 aa, Artificial Sequence
  Description of Artificial Sequence: Synthetic peptide
  Seed: QKRILVNLSM (KKLC1_HUMAN)
QVRILVNLSI

SEQ ID NO: 38019 - protein, 10 aa, Artificial Sequence
  Description of Artificial Sequence: Synthetic peptide
  Seed: LLASSILCAL (KKLC1_HUMAN)
LTASSILCAL

SEQ ID NO: 38020 - protein, 10 aa, Artificial Sequence
  Description of Artificial Sequence: Synthetic peptide
  Seed: RQKRILVNLS (KKLC1_HUMAN)
RTKRILVNLK

SEQ ID NO: 38021 - protein, 11 aa, Artificial Sequence
  Description of Artificial Sequence: Synthetic peptide
  Seed: NNFPHSIARQK (KKLC1_HUMAN)
NTFPHSIARQR

SEQ ID NO: 38022 - protein, 9 aa, Artificial Sequence
  Description of Artificial Sequence: Synthetic peptide
  Seed: SSILCALIV (KKLC1_HUMAN)
SSILCALIY

SEQ ID NO: 38023 - protein, 10 aa, Artificial Sequence
  Description of Artificial Sequence: Synthetic peptide
  Seed: RRFQRNTGEM (KKLC1_HUMAN)
RMFQRNTGEY

SEQ ID NO: 38024 - protein, 11 aa, Artificial Sequence
  Description of Artificial Sequence: Synthetic peptide
  Seed: RQKRILVNLSM (KKLC1_HUMAN)
RDKRILVNLSI

SEQ ID NO: 38025 - protein, 9 aa, Artificial Sequence
  Description of Artificial Sequence: Synthetic peptide
  Seed: FYLLLASSI (KKLC1_HUMAN)
FYLLLASSY

SEQ ID NO: 38026 - protein, 10 aa, Artificial Sequence
  Description of Artificial Sequence: Synthetic peptide
  Seed: YLLLASSILC (KKLC1_HUMAN)
YPLLASSILV

SEQ ID NO: 38027 - protein, 9 aa, Artificial Sequence
  Description of Artificial Sequence: Synthetic peptide
  Seed: LVELEHTLL (KKLC1_HUMAN)
LAELEHTLL

SEQ ID NO: 38028 - protein, 9 aa, Artificial Sequence
  Description of Artificial Sequence: Synthetic peptide
  Seed: MSSNSTALA (KKLC1_HUMAN)
MLSNSTALL

SEQ ID NO: 38029 - protein, 10 aa, Artificial Sequence
  Description of Artificial Sequence: Synthetic peptide
  Seed: SMVENKLVEL (KKLC1_HUMAN)
SVVENKLVEF

SEQ ID NO: 38030 - protein, 9 aa, Artificial Sequence
  Description of Artificial Sequence: Synthetic peptide
  Seed: LSRDILNNF (KKLC1_HUMAN)
LSRDILNNY

SEQ ID NO: 38031 - protein, 10 aa, Artificial Sequence
  Description of Artificial Sequence: Synthetic peptide
  Seed: QKRILVNLSM (KKLC1_HUMAN)
QIRILVNLSF

SEQ ID NO: 38032 - protein, 9 aa, Artificial Sequence
  Description of Artificial Sequence: Synthetic peptide
  Seed: ILNNFPHSI (KKLC1_HUMAN)
IFNNFPHSF

SEQ ID NO: 38033 - protein, 10 aa, Artificial Sequence
  Description of Artificial Sequence: Synthetic peptide
  Seed: CALIVFWKYR (KKLC1_HUMAN)
CYLIVFWKYR

SEQ ID NO: 38034 - protein, 9 aa, Artificial Sequence
  Description of Artificial Sequence: Synthetic peptide
  Seed: KYRRFQRNT (KKLC1_HUMAN)
KARRFQRNL

SEQ ID NO: 38035 - protein, 11 aa, Artificial Sequence
  Description of Artificial Sequence: Synthetic peptide
  Seed: RQKRILVNLSM (KKLC1_HUMAN)
RHKRILVNLSM

SEQ ID NO: 38036 - protein, 10 aa, Artificial Sequence
  Description of Artificial Sequence: Synthetic peptide
  Seed: YLLLASSILC (KKLC1_HUMAN)
YRLLASSILV

SEQ ID NO: 38037 - protein, 10 aa, Artificial Sequence
  Description of Artificial Sequence: Synthetic peptide
  Seed: LASSILCALI (KKLC1_HUMAN)
LQSSILCALV

SEQ ID NO: 38038 - protein, 11 aa, Artificial Sequence
  Description of Artificial Sequence: Synthetic peptide
  Seed: RQKRILVNLSM (KKLC1_HUMAN)
RRKRILVNLSV

SEQ ID NO: 38039 - protein, 9 aa, Artificial Sequence
  Description of Artificial Sequence: Synthetic peptide
  Seed: KLVELEHTL (KKLC1_HUMAN)
KQVELEHTA

SEQ ID NO: 38040 - protein, 9 aa, Artificial Sequence
  Description of Artificial Sequence: Synthetic peptide
  Seed: MVENKLVEL (KKLC1_HUMAN)
MFENKLVEY

SEQ ID NO: 38041 - protein, 9 aa, Artificial Sequence
  Description of Artificial Sequence: Synthetic peptide
  Seed: RQKRILVNL (KKLC1_HUMAN)
RGKRILVNA

SEQ ID NO: 38042 - protein, 9 aa, Artificial Sequence
  Description of Artificial Sequence: Synthetic peptide
  Seed: MVENKLVEL (KKLC1_HUMAN)
MTENKLVEL

SEQ ID NO: 38043 - protein, 10 aa, Artificial Sequence
  Description of Artificial Sequence: Synthetic peptide
  Seed: CALIVFWKYR (KKLC1_HUMAN)
CVLIVFWKYR

SEQ ID NO: 38044 - protein, 9 aa, Artificial Sequence
  Description of Artificial Sequence: Synthetic peptide
  Seed: SSNSTALAL (KKLC1_HUMAN)
SMNSTALAI

SEQ ID NO: 38045 - protein, 9 aa, Artificial Sequence
  Description of Artificial Sequence: Synthetic peptide
  Seed: NNFPHSIAR (KKLC1_HUMAN)
NQFPHSIAR

SEQ ID NO: 38046 - protein, 10 aa, Artificial Sequence
  Description of Artificial Sequence: Synthetic peptide
  Seed: CALIVFWKYR (KKLC1_HUMAN)
CWLIVFWKYR

SEQ ID NO: 38047 - protein, 10 aa, Artificial Sequence
  Description of Artificial Sequence: Synthetic peptide
  Seed: KGFRGASPHR (KKLC1_HUMAN)
KVFRGASPHM

SEQ ID NO: 38048 - protein, 9 aa, Artificial Sequence
  Description of Artificial Sequence: Synthetic peptide
  Seed: AVYDLSRDI (KKLC1_HUMAN)
ALYDLSRDI

SEQ ID NO: 38049 - protein, 9 aa, Artificial Sequence
  Description of Artificial Sequence: Synthetic peptide
  Seed: KYRRFQRNT (KKLC1_HUMAN)
KIRRFQRNG

SEQ ID NO: 38050 - protein, 9 aa, Artificial Sequence
  Description of Artificial Sequence: Synthetic peptide
  Seed: MVENKLVEL (KKLC1_HUMAN)
MQENKLVEY

SEQ ID NO: 38051 - protein, 10 aa, Artificial Sequence
  Description of Artificial Sequence: Synthetic peptide
  Seed: YLLLASSILC (KKLC1_HUMAN)
YYLLASSILI

SEQ ID NO: 38052 - protein, 9 aa, Artificial Sequence
  Description of Artificial Sequence: Synthetic peptide
  Seed: NTDNNLAVY (KKLC1_HUMAN)
NSDNNLAVM

SEQ ID NO: 38053 - protein, 8 aa, Artificial Sequence
  Description of Artificial Sequence: Synthetic peptide
  Seed: VELEHTLL (KKLC1_HUMAN)
VQLEHTLI

SEQ ID NO: 38054 - protein, 9 aa, Artificial Sequence
  Description of Artificial Sequence: Synthetic peptide
  Seed: ILNNFPHSI (KKLC1_HUMAN)
IANNFPHSI

SEQ ID NO: 38055 - protein, 9 aa, Artificial Sequence
  Description of Artificial Sequence: Synthetic peptide
  Seed: IARQKRILV (KKLC1_HUMAN)
ISRQKRILK

SEQ ID NO: 38056 - protein, 9 aa, Artificial Sequence
  Description of Artificial Sequence: Synthetic peptide
  Seed: NNFPHSIAR (KKLC1_HUMAN)
NVFPHSIAK

SEQ ID NO: 38057 - protein, 10 aa, Artificial Sequence
  Description of Artificial Sequence: Synthetic peptide
  Seed: VELEHTLLSK (KKLC1_HUMAN)
VILEHTLLSK

SEQ ID NO: 38058 - protein, 11 aa, Artificial Sequence
  Description of Artificial Sequence: Synthetic peptide
  Seed: LLASSILCALI (KKLC1_HUMAN)
LLASSILCALV

SEQ ID NO: 38059 - protein, 10 aa, Artificial Sequence
  Description of Artificial Sequence: Synthetic peptide
  Seed: DLSRDILNNF (KKLC1_HUMAN)
DVSRDILNNW

SEQ ID NO: 38060 - protein, 9 aa, Artificial Sequence
  Description of Artificial Sequence: Synthetic peptide
  Seed: RQKRILVNL (KKLC1_HUMAN)
RMKRILVNI

SEQ ID NO: 38061 - protein, 11 aa, Artificial Sequence
  Description of Artificial Sequence: Synthetic peptide
  Seed: LLLASSILCAL (KKLC1_HUMAN)
LLLASSILCAI

SEQ ID NO: 38062 - protein, 10 aa, Artificial Sequence
  Description of Artificial Sequence: Synthetic peptide
  Seed: LLLASSILCA (KKLC1_HUMAN)
LYLASSILCI

SEQ ID NO: 38063 - protein, 9 aa, Artificial Sequence
  Description of Artificial Sequence: Synthetic peptide
  Seed: KGFRGASPH (KKLC1_HUMAN)
KPFRGASPY

SEQ ID NO: 38064 - protein, 11 aa, Artificial Sequence
  Description of Artificial Sequence: Synthetic peptide
  Seed: RQKRILVNLSM (KKLC1_HUMAN)
RPKRILVNLSM

SEQ ID NO: 38065 - protein, 9 aa, Artificial Sequence
  Description of Artificial Sequence: Synthetic peptide
  Seed: SSNSTALAL (KKLC1_HUMAN)
SVNSTALAY

SEQ ID NO: 38066 - protein, 11 aa, Artificial Sequence
  Description of Artificial Sequence: Synthetic peptide
  Seed: YLLLASSILCA (KKLC1_HUMAN)
YILLASSILCI

SEQ ID NO: 38067 - protein, 11 aa, Artificial Sequence
  Description of Artificial Sequence: Synthetic peptide
  Seed: LSMVENKLVEL (KKLC1_HUMAN)
LAMVENKLVEW

SEQ ID NO: 38068 - protein, 9 aa, Artificial Sequence
  Description of Artificial Sequence: Synthetic peptide
  Seed: SSNSTALAL (KKLC1_HUMAN)
SRNSTALAL

SEQ ID NO: 38069 - protein, 9 aa, Artificial Sequence
  Description of Artificial Sequence: Synthetic peptide
  Seed: LLLASSILC (KKLC1_HUMAN)
LMLASSILV

SEQ ID NO: 38070 - protein, 9 aa, Artificial Sequence
  Description of Artificial Sequence: Synthetic peptide
  Seed: KGFRGASPH (KKLC1_HUMAN)
KLFRGASPW

SEQ ID NO: 38071 - protein, 9 aa, Artificial Sequence
  Description of Artificial Sequence: Synthetic peptide
  Seed: KLVELEHTL (KKLC1_HUMAN)
KSVELEHTW

SEQ ID NO: 38072 - protein, 10 aa, Artificial Sequence
  Description of Artificial Sequence: Synthetic peptide
  Seed: KRILVNLSMV (KKLC1_HUMAN)
KRILVNLSML

SEQ ID NO: 38073 - protein, 9 aa, Artificial Sequence
  Description of Artificial Sequence: Synthetic peptide
  Seed: KYRRFQRNT (KKLC1_HUMAN)
KWRRFQRNL

SEQ ID NO: 38074 - protein, 11 aa, Artificial Sequence
  Description of Artificial Sequence: Synthetic peptide
  Seed: IVFWKYRRFQR (KKLC1_HUMAN)
IMFWKYRRFQK

SEQ ID NO: 38075 - protein, 9 aa, Artificial Sequence
  Description of Artificial Sequence: Synthetic peptide
  Seed: YLLLASSIL (KKLC1_HUMAN)
YFLLASSII

SEQ ID NO: 38076 - protein, 10 aa, Artificial Sequence
  Description of Artificial Sequence: Synthetic peptide
  Seed: YLLLASSILC (KKLC1_HUMAN)
YDLLASSILL

SEQ ID NO: 38077 - protein, 10 aa, Artificial Sequence
  Description of Artificial Sequence: Synthetic peptide
  Seed: LASSILCALI (KKLC1_HUMAN)
LMSSILCALT

SEQ ID NO: 38078 - protein, 10 aa, Artificial Sequence
  Description of Artificial Sequence: Synthetic peptide
  Seed: ILCALIVFWK (KKLC1_HUMAN)
IYCALIVFWR

SEQ ID NO: 38079 - protein, 10 aa, Artificial Sequence
  Description of Artificial Sequence: Synthetic peptide
  Seed: QKRILVNLSM (KKLC1_HUMAN)
QMRILVNLSI

SEQ ID NO: 38080 - protein, 9 aa, Artificial Sequence
  Description of Artificial Sequence: Synthetic peptide
  Seed: KYRRFQRNT (KKLC1_HUMAN)
KGRRFQRNV

SEQ ID NO: 38081 - protein, 10 aa, Artificial Sequence
  Description of Artificial Sequence: Synthetic peptide
  Seed: SSILCALIVF (KKLC1_HUMAN)
SSILCALIVW

SEQ ID NO: 38082 - protein, 10 aa, Artificial Sequence
  Description of Artificial Sequence: Synthetic peptide
  Seed: YLLLASSILC (KKLC1_HUMAN)
YMLLASSILI

SEQ ID NO: 38083 - protein, 9 aa, Artificial Sequence
  Description of Artificial Sequence: Synthetic peptide
  Seed: YLLLASSIL (KKLC1_HUMAN)
YWLLASSIL

SEQ ID NO: 38084 - protein, 9 aa, Artificial Sequence
  Description of Artificial Sequence: Synthetic peptide
  Seed: VENKLVELE (KKLC1_HUMAN)
VENKLVELT

SEQ ID NO: 38085 - protein, 9 aa, Artificial Sequence
  Description of Artificial Sequence: Synthetic peptide
  Seed: VNLSMVENK (KKLC1_HUMAN)
VILSMVENK

SEQ ID NO: 38086 - protein, 9 aa, Artificial Sequence
  Description of Artificial Sequence: Synthetic peptide
  Seed: LLSKGFRGA (KKLC1_HUMAN)
LLSKGFRGL

SEQ ID NO: 38087 - protein, 9 aa, Artificial Sequence
  Description of Artificial Sequence: Synthetic peptide
  Seed: KLVELEHTL (KKLC1_HUMAN)
KFVELEHTL

SEQ ID NO: 38088 - protein, 10 aa, Artificial Sequence
  Description of Artificial Sequence: Synthetic peptide
  Seed: EMSSNSTALA (KKLC1_HUMAN)
EHSSNSTALV

SEQ ID NO: 38089 - protein, 10 aa, Artificial Sequence
  Description of Artificial Sequence: Synthetic peptide
  Seed: ILCALIVFWK (KKLC1_HUMAN)
IVCALIVFWR

SEQ ID NO: 38090 - protein, 11 aa, Artificial Sequence
  Description of Artificial Sequence: Synthetic peptide
  Seed: ILNNFPHSIAR (KKLC1_HUMAN)
IINNFPHSIAR

SEQ ID NO: 38091 - protein, 10 aa, Artificial Sequence
  Description of Artificial Sequence: Synthetic peptide
  Seed: QKRILVNLSM (KKLC1_HUMAN)
QLRILVNLSI

SEQ ID NO: 38092 - protein, 9 aa, Artificial Sequence
  Description of Artificial Sequence: Synthetic peptide
  Seed: YLLLASSIL (KKLC1_HUMAN)
YFLLASSIY

SEQ ID NO: 38093 - protein, 9 aa, Artificial Sequence
  Description of Artificial Sequence: Synthetic peptide
  Seed: YLLLASSIL (KKLC1_HUMAN)
YQLLASSIH

SEQ ID NO: 38094 - protein, 9 aa, Artificial Sequence
  Description of Artificial Sequence: Synthetic peptide
  Seed: LVRPSSSGL (KKLC1_HUMAN)
LPRPSSSGF

SEQ ID NO: 38095 - protein, 10 aa, Artificial Sequence
  Description of Artificial Sequence: Synthetic peptide
  Seed: LASSILCALI (KKLC1_HUMAN)
LYSSILCALW

SEQ ID NO: 38096 - protein, 9 aa, Artificial Sequence
  Description of Artificial Sequence: Synthetic peptide
  Seed: RRFQRNTGE (KKLC1_HUMAN)
RRFQRNTGF

SEQ ID NO: 38097 - protein, 9 aa, Artificial Sequence
  Description of Artificial Sequence: Synthetic peptide
  Seed: NLAVYDLSR (KKLC1_HUMAN)
NTAVYDLSR

SEQ ID NO: 38098 - protein, 10 aa, Artificial Sequence
  Description of Artificial Sequence: Synthetic peptide
  Seed: GEMSSNSTAL (KKLC1_HUMAN)
GLMSSNSTAV

SEQ ID NO: 38099 - protein, 9 aa, Artificial Sequence
  Description of Artificial Sequence: Synthetic peptide
  Seed: KYRRFQRNT (KKLC1_HUMAN)
KSRRFQRNV

SEQ ID NO: 38100 - protein, 11 aa, Artificial Sequence
  Description of Artificial Sequence: Synthetic peptide
  Seed: RQKRILVNLSM (KKLC1_HUMAN)
RKKRILVNLSM

SEQ ID NO: 38101 - protein, 9 aa, Artificial Sequence
  Description of Artificial Sequence: Synthetic peptide
  Seed: SSNSTALAL (KKLC1_HUMAN)
SRNSTALAM

SEQ ID NO: 38102 - protein, 9 aa, Artificial Sequence
  Description of Artificial Sequence: Synthetic peptide
  Seed: MVENKLVEL (KKLC1_HUMAN)
MLENKLVEM

SEQ ID NO: 38103 - protein, 10 aa, Artificial Sequence
  Description of Artificial Sequence: Synthetic peptide
  Seed: ALIVFWKYRR (KKLC1_HUMAN)
AKIVFWKYRR

SEQ ID NO: 38104 - protein, 9 aa, Artificial Sequence
  Description of Artificial Sequence: Synthetic peptide
  Seed: KYRRFQRNT (KKLC1_HUMAN)
KTRRFQRNF

SEQ ID NO: 38105 - protein, 8 aa, Artificial Sequence
  Description of Artificial Sequence: Synthetic peptide
  Seed: FQRNTGEM (KKLC1_HUMAN)
FARNTGEY

SEQ ID NO: 38106 - protein, 10 aa, Artificial Sequence
  Description of Artificial Sequence: Synthetic peptide
  Seed: VFWKYRRFQR (KKLC1_HUMAN)
VLWKYRRFQR

SEQ ID NO: 38107 - protein, 11 aa, Artificial Sequence
  Description of Artificial Sequence: Synthetic peptide
  Seed: LSMVENKLVEL (KKLC1_HUMAN)
LLMVENKLVEA

SEQ ID NO: 38108 - protein, 10 aa, Artificial Sequence
  Description of Artificial Sequence: Synthetic peptide
  Seed: GEMSSNSTAL (KKLC1_HUMAN)
GNMSSNSTAV

SEQ ID NO: 38109 - protein, 10 aa, Artificial Sequence
  Description of Artificial Sequence: Synthetic peptide
  Seed: SNSTALALVR (KKLC1_HUMAN)
STSTALALVK

SEQ ID NO: 38110 - protein, 10 aa, Artificial Sequence
  Description of Artificial Sequence: Synthetic peptide
  Seed: RQKRILVNLS (KKLC1_HUMAN)
RVKRILVNLK

SEQ ID NO: 38111 - protein, 9 aa, Artificial Sequence
  Description of Artificial Sequence: Synthetic peptide
  Seed: HTLLSKGFR (KKLC1_HUMAN)
HVLLSKGFR

SEQ ID NO: 38112 - protein, 9 aa, Artificial Sequence
  Description of Artificial Sequence: Synthetic peptide
  Seed: LSRDILNNF (KKLC1_HUMAN)
LRRDILNNF

SEQ ID NO: 38113 - protein, 9 aa, Artificial Sequence
  Description of Artificial Sequence: Synthetic peptide
  Seed: SSNSTALAL (KKLC1_HUMAN)
SLNSTALAW

SEQ ID NO: 38114 - protein, 11 aa, Artificial Sequence
  Description of Artificial Sequence: Synthetic peptide
  Seed: KGFRGASPHRK (KKLC1_HUMAN)
KLFRGASPHRR

SEQ ID NO: 38115 - protein, 9 aa, Artificial Sequence
  Description of Artificial Sequence: Synthetic peptide
  Seed: MVENKLVEL (KKLC1_HUMAN)
MIENKLVEM

SEQ ID NO: 38116 - protein, 9 aa, Artificial Sequence
  Description of Artificial Sequence: Synthetic peptide
  Seed: SILCALIVF (KKLC1_HUMAN)
SQLCALIVF

SEQ ID NO: 38117 - protein, 9 aa, Artificial Sequence
  Description of Artificial Sequence: Synthetic peptide
  Seed: RQKRILVNL (KKLC1_HUMAN)
RQKRILVNY

SEQ ID NO: 38118 - protein, 10 aa, Artificial Sequence
  Description of Artificial Sequence: Synthetic peptide
  Seed: MSSNSTALAL (KKLC1_HUMAN)
MKSNSTALAF

SEQ ID NO: 38119 - protein, 8 aa, Artificial Sequence
  Description of Artificial Sequence: Synthetic peptide
  Seed: VYDLSRDI (KKLC1_HUMAN)
VFDLSRDL

SEQ ID NO: 38120 - protein, 10 aa, Artificial Sequence
  Description of Artificial Sequence: Synthetic peptide
  Seed: ALVRPSSSGL (KKLC1_HUMAN)
ATVRPSSSGK

SEQ ID NO: 38121 - protein, 9 aa, Artificial Sequence
  Description of Artificial Sequence: Synthetic peptide
  Seed: LASSILCAL (KKLC1_HUMAN)
LRSSILCAM

SEQ ID NO: 38122 - protein, 10 aa, Artificial Sequence
  Description of Artificial Sequence: Synthetic peptide
  Seed: YLLLASSILC (KKLC1_HUMAN)
YPLLASSILA

SEQ ID NO: 38123 - protein, 9 aa, Artificial Sequence
  Description of Artificial Sequence: Synthetic peptide
  Seed: LLLASSILC (KKLC1_HUMAN)
LVLASSILV

SEQ ID NO: 38124 - protein, 9 aa, Artificial Sequence
  Description of Artificial Sequence: Synthetic peptide
  Seed: NNFPHSIAR (KKLC1_HUMAN)
NAFPHSIAH

SEQ ID NO: 38125 - protein, 10 aa, Artificial Sequence
  Description of Artificial Sequence: Synthetic peptide
  Seed: LLLASSILCA (KKLC1_HUMAN)
LALASSILCV

SEQ ID NO: 38126 - protein, 10 aa, Artificial Sequence
  Description of Artificial Sequence: Synthetic peptide
  Seed: RRFQRNTGEM (KKLC1_HUMAN)
RRFQRNTGEL

SEQ ID NO: 38127 - protein, 11 aa, Artificial Sequence
  Description of Artificial Sequence: Synthetic peptide
  Seed: YLLLASSILCA (KKLC1_HUMAN)
YPLLASSILCI

SEQ ID NO: 38128 - protein, 10 aa, Artificial Sequence
  Description of Artificial Sequence: Synthetic peptide
  Seed: LVRPSSSGLI (KKLC1_HUMAN)
LSRPSSSGLK

SEQ ID NO: 38129 - protein, 10 aa, Artificial Sequence
  Description of Artificial Sequence: Synthetic peptide
  Seed: GEMSSNSTAL (KKLC1_HUMAN)
GMMSSNSTAY

SEQ ID NO: 38130 - protein, 10 aa, Artificial Sequence
  Description of Artificial Sequence: Synthetic peptide
  Seed: LASSILCALI (KKLC1_HUMAN)
LLSSILCALS

SEQ ID NO: 38131 - protein, 8 aa, Artificial Sequence
  Description of Artificial Sequence: Synthetic peptide
  Seed: LSMVENKL (KKLC1_HUMAN)
LQMVENKV

SEQ ID NO: 38132 - protein, 9 aa, Artificial Sequence
  Description of Artificial Sequence: Synthetic peptide
  Seed: MVENKLVEL (KKLC1_HUMAN)
MMENKLVEF

SEQ ID NO: 38133 - protein, 9 aa, Artificial Sequence
  Description of Artificial Sequence: Synthetic peptide
  Seed: SSILCALIV (KKLC1_HUMAN)
STILCALIF

SEQ ID NO: 38134 - protein, 9 aa, Artificial Sequence
  Description of Artificial Sequence: Synthetic peptide
  Seed: AVYDLSRDI (KKLC1_HUMAN)
AMYDLSRDL

SEQ ID NO: 38135 - protein, 11 aa, Artificial Sequence
  Description of Artificial Sequence: Synthetic peptide
  Seed: RQKRILVNLSM (KKLC1_HUMAN)
RRKRILVNLSR

SEQ ID NO: 38136 - protein, 9 aa, Artificial Sequence
  Description of Artificial Sequence: Synthetic peptide
  Seed: YLLLASSIL (KKLC1_HUMAN)
YRLLASSIM

SEQ ID NO: 38137 - protein, 9 aa, Artificial Sequence
  Description of Artificial Sequence: Synthetic peptide
  Seed: FPHSIARQK (KKLC1_HUMAN)
FTHSIARQR

SEQ ID NO: 38138 - protein, 9 aa, Artificial Sequence
  Description of Artificial Sequence: Synthetic peptide
  Seed: MSSNSTALA (KKLC1_HUMAN)
MSSNSTALV

SEQ ID NO: 38139 - protein, 9 aa, Artificial Sequence
  Description of Artificial Sequence: Synthetic peptide
  Seed: AVYDLSRDI (KKLC1_HUMAN)
AAYDLSRDV

SEQ ID NO: 38140 - protein, 9 aa, Artificial Sequence
  Description of Artificial Sequence: Synthetic peptide
  Seed: NNFPHSIAR (KKLC1_HUMAN)
NCFPHSIAR

SEQ ID NO: 38141 - protein, 10 aa, Artificial Sequence
  Description of Artificial Sequence: Synthetic peptide
  Seed: RQKRILVNLS (KKLC1_HUMAN)
RMKRILVNLA

SEQ ID NO: 38142 - protein, 10 aa, Artificial Sequence
  Description of Artificial Sequence: Synthetic peptide
  Seed: ALIVFWKYRR (KKLC1_HUMAN)
AAIVFWKYRR

SEQ ID NO: 38143 - protein, 9 aa, Artificial Sequence
  Description of Artificial Sequence: Synthetic peptide
  Seed: IARQKRILV (KKLC1_HUMAN)
IQRQKRILK

SEQ ID NO: 38144 - protein, 9 aa, Artificial Sequence
  Description of Artificial Sequence: Synthetic peptide
  Seed: SSNSTALAL (KKLC1_HUMAN)
SSNSTALAM

SEQ ID NO: 38145 - protein, 11 aa, Artificial Sequence
  Description of Artificial Sequence: Synthetic peptide
  Seed: RQKRILVNLSM (KKLC1_HUMAN)
RLKRILVNLSR

SEQ ID NO: 38146 - protein, 9 aa, Artificial Sequence
  Description of Artificial Sequence: Synthetic peptide
  Seed: FPHSIARQK (KKLC1_HUMAN)
FPHSIARQV

SEQ ID NO: 38147 - protein, 8 aa, Artificial Sequence
  Description of Artificial Sequence: Synthetic peptide
  Seed: NTDNNLAV (KKLC1_HUMAN)
NIDNNLAL

SEQ ID NO: 38148 - protein, 10 aa, Artificial Sequence
  Description of Artificial Sequence: Synthetic peptide
  Seed: VFWKYRRFQR (KKLC1_HUMAN)
VGWKYRRFQR

SEQ ID NO: 38149 - protein, 9 aa, Artificial Sequence
  Description of Artificial Sequence: Synthetic peptide
  Seed: VELEHTLLS (KKLC1_HUMAN)
VELEHTLLP

SEQ ID NO: 38150 - protein, 10 aa, Artificial Sequence
  Description of Artificial Sequence: Synthetic peptide
  Seed: MSSNSTALAL (KKLC1_HUMAN)
MFSNSTALAW

SEQ ID NO: 38151 - protein, 10 aa, Artificial Sequence
  Description of Artificial Sequence: Synthetic peptide
  Seed: YLLLASSILC (KKLC1_HUMAN)
YFLLASSILA

SEQ ID NO: 38152 - protein, 10 aa, Artificial Sequence
  Description of Artificial Sequence: Synthetic peptide
  Seed: YLLLASSILC (KKLC1_HUMAN)
YRLLASSILM

SEQ ID NO: 38153 - protein, 10 aa, Artificial Sequence
  Description of Artificial Sequence: Synthetic peptide
  Seed: LLASSILCAL (KKLC1_HUMAN)
LLASSILCAY

SEQ ID NO: 38154 - protein, 9 aa, Artificial Sequence
  Description of Artificial Sequence: Synthetic peptide
  Seed: SILCALIVF (KKLC1_HUMAN)
SQLCALIVM

SEQ ID NO: 38155 - protein, 9 aa, Artificial Sequence
  Description of Artificial Sequence: Synthetic peptide
  Seed: SSNSTALAL (KKLC1_HUMAN)
STNSTALAV

SEQ ID NO: 38156 - protein, 11 aa, Artificial Sequence
  Description of Artificial Sequence: Synthetic peptide
  Seed: KGFRGASPHRK (KKLC1_HUMAN)
KTFRGASPHRR

SEQ ID NO: 38157 - protein, 9 aa, Artificial Sequence
  Description of Artificial Sequence: Synthetic peptide
  Seed: ELEHTLLSK (KKLC1_HUMAN)
ETEHTLLSR

SEQ ID NO: 38158 - protein, 10 aa, Artificial Sequence
  Description of Artificial Sequence: Synthetic peptide
  Seed: MSSNSTALAL (KKLC1_HUMAN)
MVSNSTALAI

SEQ ID NO: 38159 - protein, 9 aa, Artificial Sequence
  Description of Artificial Sequence: Synthetic peptide
  Seed: LSRDILNNF (KKLC1_HUMAN)
LGRDILNNY

SEQ ID NO: 38160 - protein, 9 aa, Artificial Sequence
  Description of Artificial Sequence: Synthetic peptide
  Seed: NNFPHSIAR (KKLC1_HUMAN)
NLFPHSIAL

SEQ ID NO: 38161 - protein, 9 aa, Artificial Sequence
  Description of Artificial Sequence: Synthetic peptide
  Seed: NTDNNLAVY (KKLC1_HUMAN)
NVDNNLAVF

SEQ ID NO: 38162 - protein, 9 aa, Artificial Sequence
  Description of Artificial Sequence: Synthetic peptide
  Seed: MSSNSTALA (KKLC1_HUMAN)
MMSNSTALA

SEQ ID NO: 38163 - protein, 9 aa, Artificial Sequence
  Description of Artificial Sequence: Synthetic peptide
  Seed: LASSILCAL (KKLC1_HUMAN)
LSSSILCAW

SEQ ID NO: 38164 - protein, 10 aa, Artificial Sequence
  Description of Artificial Sequence: Synthetic peptide
  Seed: SNTDNNLAVY (KKLC1_HUMAN)
SDTDNNLAVY

SEQ ID NO: 38165 - protein, 10 aa, Artificial Sequence
  Description of Artificial Sequence: Synthetic peptide
  Seed: SMVENKLVEL (KKLC1_HUMAN)
SKVENKLVEF

SEQ ID NO: 38166 - protein, 9 aa, Artificial Sequence
  Description of Artificial Sequence: Synthetic peptide
  Seed: SNTDNNLAV (KKLC1_HUMAN)
SYTDNNLAL

SEQ ID NO: 38167 - protein, 9 aa, Artificial Sequence
  Description of Artificial Sequence: Synthetic peptide
  Seed: GEMSSNSTA (KKLC1_HUMAN)
GEMSSNSTL

SEQ ID NO: 38168 - protein, 9 aa, Artificial Sequence
  Description of Artificial Sequence: Synthetic peptide
  Seed: NNFPHSIAR (KKLC1_HUMAN)
NLFPHSIAK

SEQ ID NO: 38169 - protein, 9 aa, Artificial Sequence
  Description of Artificial Sequence: Synthetic peptide
  Seed: KYRRFQRNT (KKLC1_HUMAN)
KSRRFQRNA

SEQ ID NO: 38170 - protein, 10 aa, Artificial Sequence
  Description of Artificial Sequence: Synthetic peptide
  Seed: TGEMSSNSTA (KKLC1_HUMAN)
TLEMSSNSTA

SEQ ID NO: 38171 - protein, 10 aa, Artificial Sequence
  Description of Artificial Sequence: Synthetic peptide
  Seed: GEMSSNSTAL (KKLC1_HUMAN)
GAMSSNSTAY

SEQ ID NO: 38172 - protein, 9 aa, Artificial Sequence
  Description of Artificial Sequence: Synthetic peptide
  Seed: EHTLLSKGF (KKLC1_HUMAN)
EHTLLSKGI

SEQ ID NO: 38173 - protein, 9 aa, Artificial Sequence
  Description of Artificial Sequence: Synthetic peptide
  Seed: NTDNNLAVY (KKLC1_HUMAN)
NLDNNLAVM

SEQ ID NO: 38174 - protein, 10 aa, Artificial Sequence
  Description of Artificial Sequence: Synthetic peptide
  Seed: LLASSILCAL (KKLC1_HUMAN)
LIASSILCAY

SEQ ID NO: 38175 - protein, 10 aa, Artificial Sequence
  Description of Artificial Sequence: Synthetic peptide
  Seed: QKRILVNLSM (KKLC1_HUMAN)
QKRILVNLSF

SEQ ID NO: 38176 - protein, 10 aa, Artificial Sequence
  Description of Artificial Sequence: Synthetic peptide
  Seed: RQKRILVNLS (KKLC1_HUMAN)
RSKRILVNLV

SEQ ID NO: 38177 - protein, 10 aa, Artificial Sequence
  Description of Artificial Sequence: Synthetic peptide
  Seed: YLLLASSILC (KKLC1_HUMAN)
YSLLASSILM

SEQ ID NO: 38178 - protein, 10 aa, Artificial Sequence
  Description of Artificial Sequence: Synthetic peptide
  Seed: LLLASSILCA (KKLC1_HUMAN)
LHLASSILCV

SEQ ID NO: 38179 - protein, 9 aa, Artificial Sequence
  Description of Artificial Sequence: Synthetic peptide
  Seed: RILVNLSMV (KKLC1_HUMAN)
RLLVNLSMI

SEQ ID NO: 38180 - protein, 11 aa, Artificial Sequence
  Description of Artificial Sequence: Synthetic peptide
  Seed: KLVELEHTLLS (KKLC1_HUMAN)
KLVELEHTLLM

SEQ ID NO: 38181 - protein, 9 aa, Artificial Sequence
  Description of Artificial Sequence: Synthetic peptide
  Seed: LASSILCAL (KKLC1_HUMAN)
LTSSILCAA

SEQ ID NO: 38182 - protein, 8 aa, Artificial Sequence
  Description of Artificial Sequence: Synthetic peptide
  Seed: VYDLSRDI (KKLC1_HUMAN)
VTDLSRDV

SEQ ID NO: 38183 - protein, 10 aa, Artificial Sequence
  Description of Artificial Sequence: Synthetic peptide
  Seed: QKRILVNLSM (KKLC1_HUMAN)
QTRILVNLSL

SEQ ID NO: 38184 - protein, 9 aa, Artificial Sequence
  Description of Artificial Sequence: Synthetic peptide
  Seed: SSILCALIV (KKLC1_HUMAN)
SSILCALIW

SEQ ID NO: 38185 - protein, 10 aa, Artificial Sequence
  Description of Artificial Sequence: Synthetic peptide
  Seed: KGFRGASPHR (KKLC1_HUMAN)
KNFRGASPHA

SEQ ID NO: 38186 - protein, 10 aa, Artificial Sequence
  Description of Artificial Sequence: Synthetic peptide
  Seed: GFRGASPHRK (KKLC1_HUMAN)
GVRGASPHRK

SEQ ID NO: 38187 - protein, 9 aa, Artificial Sequence
  Description of Artificial Sequence: Synthetic peptide
  Seed: KGFRGASPH (KKLC1_HUMAN)
KRFRGASPF

SEQ ID NO: 38188 - protein, 10 aa, Artificial Sequence
  Description of Artificial Sequence: Synthetic peptide
  Seed: KGFRGASPHR (KKLC1_HUMAN)
KFFRGASPHR

SEQ ID NO: 38189 - protein, 10 aa, Artificial Sequence
  Description of Artificial Sequence: Synthetic peptide
  Seed: QKRILVNLSM (KKLC1_HUMAN)
QWRILVNLSF

SEQ ID NO: 38190 - protein, 10 aa, Artificial Sequence
  Description of Artificial Sequence: Synthetic peptide
  Seed: YLLLASSILC (KKLC1_HUMAN)
YSLLASSILA

SEQ ID NO: 38191 - protein, 9 aa, Artificial Sequence
  Description of Artificial Sequence: Synthetic peptide
  Seed: MVENKLVEL (KKLC1_HUMAN)
MLENKLVEV

SEQ ID NO: 38192 - protein, 9 aa, Artificial Sequence
  Description of Artificial Sequence: Synthetic peptide
  Seed: MVENKLVEL (KKLC1_HUMAN)
MYENKLVEY

SEQ ID NO: 38193 - protein, 10 aa, Artificial Sequence
  Description of Artificial Sequence: Synthetic peptide
  Seed: ALVRPSSSGL (KKLC1_HUMAN)
AMVRPSSSGK

SEQ ID NO: 38194 - protein, 10 aa, Artificial Sequence
  Description of Artificial Sequence: Synthetic peptide
  Seed: AVYDLSRDIL (KKLC1_HUMAN)
ALYDLSRDIV

SEQ ID NO: 38195 - protein, 10 aa, Artificial Sequence
  Description of Artificial Sequence: Synthetic peptide
  Seed: YLLLASSILC (KKLC1_HUMAN)
YLLLASSILA

SEQ ID NO: 38196 - protein, 9 aa, Artificial Sequence
  Description of Artificial Sequence: Synthetic peptide
  Seed: SSNSTALAL (KKLC1_HUMAN)
SYNSTALAM

SEQ ID NO: 38197 - protein, 9 aa, Artificial Sequence
  Description of Artificial Sequence: Synthetic peptide
  Seed: YLLLASSIL (KKLC1_HUMAN)
YQLLASSIA

SEQ ID NO: 38198 - protein, 11 aa, Artificial Sequence
  Description of Artificial Sequence: Synthetic peptide
  Seed: IVFWKYRRFQR (KKLC1_HUMAN)
ITFWKYRRFQR

SEQ ID NO: 38199 - protein, 9 aa, Artificial Sequence
  Description of Artificial Sequence: Synthetic peptide
  Seed: YLLLASSIL (KKLC1_HUMAN)
YSLLASSIF

SEQ ID NO: 38200 - protein, 9 aa, Artificial Sequence
  Description of Artificial Sequence: Synthetic peptide
  Seed: EMSSNSTAL (KKLC1_HUMAN)
EQSSNSTAF

SEQ ID NO: 38201 - protein, 10 aa, Artificial Sequence
  Description of Artificial Sequence: Synthetic peptide
  Seed: MSSNSTALAL (KKLC1_HUMAN)
MASNSTALAW

SEQ ID NO: 38202 - protein, 11 aa, Artificial Sequence
  Description of Artificial Sequence: Synthetic peptide
  Seed: NNFPHSIARQK (KKLC1_HUMAN)
NGFPHSIARQR

SEQ ID NO: 38203 - protein, 9 aa, Artificial Sequence
  Description of Artificial Sequence: Synthetic peptide
  Seed: KGFRGASPH (KKLC1_HUMAN)
KWFRGASPF

SEQ ID NO: 38204 - protein, 9 aa, Artificial Sequence
  Description of Artificial Sequence: Synthetic peptide
  Seed: LLSKGFRGA (KKLC1_HUMAN)
LMSKGFRGI

SEQ ID NO: 38205 - protein, 11 aa, Artificial Sequence
  Description of Artificial Sequence: Synthetic peptide
  Seed: YLLLASSILCA (KKLC1_HUMAN)
YMLLASSILCI

SEQ ID NO: 38206 - protein, 9 aa, Artificial Sequence
  Description of Artificial Sequence: Synthetic peptide
  Seed: KLVELEHTL (KKLC1_HUMAN)
KLVELEHTT

SEQ ID NO: 38207 - protein, 8 aa, Artificial Sequence
  Description of Artificial Sequence: Synthetic peptide
  Seed: VYDLSRDI (KKLC1_HUMAN)
VIDLSRDI

SEQ ID NO: 38208 - protein, 9 aa, Artificial Sequence
  Description of Artificial Sequence: Synthetic peptide
  Seed: VNLSMVENK (KKLC1_HUMAN)
VALSMVENL

SEQ ID NO: 38209 - protein, 10 aa, Artificial Sequence
  Description of Artificial Sequence: Synthetic peptide
  Seed: EMSSNSTALA (KKLC1_HUMAN)
ESSSNSTALV

SEQ ID NO: 38210 - protein, 10 aa, Artificial Sequence
  Description of Artificial Sequence: Synthetic peptide
  Seed: NFYLLLASSI (KKLC1_HUMAN)
NHYLLLASSF

SEQ ID NO: 38211 - protein, 9 aa, Artificial Sequence
  Description of Artificial Sequence: Synthetic peptide
  Seed: RQKRILVNL (KKLC1_HUMAN)
RSKRILVNQ

SEQ ID NO: 38212 - protein, 9 aa, Artificial Sequence
  Description of Artificial Sequence: Synthetic peptide
  Seed: ILNNFPHSI (KKLC1_HUMAN)
IMNNFPHSL

SEQ ID NO: 38213 - protein, 11 aa, Artificial Sequence
  Description of Artificial Sequence: Synthetic peptide
  Seed: SILCALIVFWK (KKLC1_HUMAN)
STLCALIVFWK

SEQ ID NO: 38214 - protein, 9 aa, Artificial Sequence
  Description of Artificial Sequence: Synthetic peptide
  Seed: RQKRILVNL (KKLC1_HUMAN)
RMKRILVNW

SEQ ID NO: 38215 - protein, 10 aa, Artificial Sequence
  Description of Artificial Sequence: Synthetic peptide
  Seed: ALVRPSSSGL (KKLC1_HUMAN)
AGVRPSSSGK

SEQ ID NO: 38216 - protein, 10 aa, Artificial Sequence
  Description of Artificial Sequence: Synthetic peptide
  Seed: LLLASSILCA (KKLC1_HUMAN)
LNLASSILCL

SEQ ID NO: 38217 - protein, 10 aa, Artificial Sequence
  Description of Artificial Sequence: Synthetic peptide
  Seed: MSSNSTALAL (KKLC1_HUMAN)
MASNSTALAF

SEQ ID NO: 38218 - protein, 9 aa, Artificial Sequence
  Description of Artificial Sequence: Synthetic peptide
  Seed: LVELEHTLL (KKLC1_HUMAN)
LAELEHTLM

SEQ ID NO: 38219 - protein, 10 aa, Artificial Sequence
  Description of Artificial Sequence: Synthetic peptide
  Seed: GEMSSNSTAL (KKLC1_HUMAN)
GAMSSNSTAF

SEQ ID NO: 38220 - protein, 9 aa, Artificial Sequence
  Description of Artificial Sequence: Synthetic peptide
  Seed: RQKRILVNL (KKLC1_HUMAN)
RMKRILVNG

SEQ ID NO: 38221 - protein, 9 aa, Artificial Sequence
  Description of Artificial Sequence: Synthetic peptide
  Seed: LVRPSSSGL (KKLC1_HUMAN)
LSRPSSSGW

SEQ ID NO: 38222 - protein, 9 aa, Artificial Sequence
  Description of Artificial Sequence: Synthetic peptide
  Seed: ILNNFPHSI (KKLC1_HUMAN)
IHNNFPHSY

SEQ ID NO: 38223 - protein, 9 aa, Artificial Sequence
  Description of Artificial Sequence: Synthetic peptide
  Seed: LVRPSSSGL (KKLC1_HUMAN)
LIRPSSSGW

SEQ ID NO: 38224 - protein, 10 aa, Artificial Sequence
  Description of Artificial Sequence: Synthetic peptide
  Seed: SMVENKLVEL (KKLC1_HUMAN)
SQVENKLVEM

SEQ ID NO: 38225 - protein, 11 aa, Artificial Sequence
  Description of Artificial Sequence: Synthetic peptide
  Seed: ILNNFPHSIAR (KKLC1_HUMAN)
IFNNFPHSIAR

SEQ ID NO: 38226 - protein, 9 aa, Artificial Sequence
  Description of Artificial Sequence: Synthetic peptide
  Seed: KRILVNLSM (KKLC1_HUMAN)
KEILVNLSM

SEQ ID NO: 38227 - protein, 9 aa, Artificial Sequence
  Description of Artificial Sequence: Synthetic peptide
  Seed: LVRPSSSGL (KKLC1_HUMAN)
LLRPSSSGY

SEQ ID NO: 38228 - protein, 10 aa, Artificial Sequence
  Description of Artificial Sequence: Synthetic peptide
  Seed: MSSNSTALAL (KKLC1_HUMAN)
MLSNSTALAI

SEQ ID NO: 38229 - protein, 9 aa, Artificial Sequence
  Description of Artificial Sequence: Synthetic peptide
  Seed: AVYDLSRDI (KKLC1_HUMAN)
ALYDLSRDV

SEQ ID NO: 38230 - protein, 9 aa, Artificial Sequence
  Description of Artificial Sequence: Synthetic peptide
  Seed: RQKRILVNL (KKLC1_HUMAN)
RAKRILVNA

SEQ ID NO: 38231 - protein, 10 aa, Artificial Sequence
  Description of Artificial Sequence: Synthetic peptide
  Seed: QKRILVNLSM (KKLC1_HUMAN)
QNRILVNLSI

SEQ ID NO: 38232 - protein, 9 aa, Artificial Sequence
  Description of Artificial Sequence: Synthetic peptide
  Seed: SSNSTALAL (KKLC1_HUMAN)
SQNSTALAH

SEQ ID NO: 38233 - protein, 9 aa, Artificial Sequence
  Description of Artificial Sequence: Synthetic peptide
  Seed: IVFWKYRRF (KKLC1_HUMAN)
IAFWKYRRY

SEQ ID NO: 38234 - protein, 9 aa, Artificial Sequence
  Description of Artificial Sequence: Synthetic peptide
  Seed: LIVFWKYRR (KKLC1_HUMAN)
LWVFWKYRK

SEQ ID NO: 38235 - protein, 9 aa, Artificial Sequence
  Description of Artificial Sequence: Synthetic peptide
  Seed: ILNNFPHSI (KKLC1_HUMAN)
IYNNFPHSI

SEQ ID NO: 38236 - protein, 11 aa, Artificial Sequence
  Description of Artificial Sequence: Synthetic peptide
  Seed: IVFWKYRRFQR (KKLC1_HUMAN)
IIFWKYRRFQR

SEQ ID NO: 38237 - protein, 10 aa, Artificial Sequence
  Description of Artificial Sequence: Synthetic peptide
  Seed: LASSILCALI (KKLC1_HUMAN)
LMSSILCALL

SEQ ID NO: 38238 - protein, 11 aa, Artificial Sequence
  Description of Artificial Sequence: Synthetic peptide
  Seed: NNFPHSIARQK (KKLC1_HUMAN)
NYFPHSIARQR

SEQ ID NO: 38239 - protein, 10 aa, Artificial Sequence
  Description of Artificial Sequence: Synthetic peptide
  Seed: KYRRFQRNTG (KKLC1_HUMAN)
KVRRFQRNTK

SEQ ID NO: 38240 - protein, 9 aa, Artificial Sequence
  Description of Artificial Sequence: Synthetic peptide
  Seed: SNSTALALV (KKLC1_HUMAN)
SASTALALL

SEQ ID NO: 38241 - protein, 9 aa, Artificial Sequence
  Description of Artificial Sequence: Synthetic peptide
  Seed: KLVELEHTL (KKLC1_HUMAN)
KWVELEHTY

SEQ ID NO: 38242 - protein, 9 aa, Artificial Sequence
  Description of Artificial Sequence: Synthetic peptide
  Seed: KLVELEHTL (KKLC1_HUMAN)
KPVELEHTF

SEQ ID NO: 38243 - protein, 9 aa, Artificial Sequence
  Description of Artificial Sequence: Synthetic peptide
  Seed: VYDLSRDIL (KKLC1_HUMAN)
VTDLSRDIM

SEQ ID NO: 38244 - protein, 9 aa, Artificial Sequence
  Description of Artificial Sequence: Synthetic peptide
  Seed: RILVNLSMV (KKLC1_HUMAN)
RSLVNLSMK

SEQ ID NO: 38245 - protein, 9 aa, Artificial Sequence
  Description of Artificial Sequence: Synthetic peptide
  Seed: NLSMVENKL (KKLC1_HUMAN)
NQSMVENKV

SEQ ID NO: 38246 - protein, 9 aa, Artificial Sequence
  Description of Artificial Sequence: Synthetic peptide
  Seed: VYDLSRDIL (KKLC1_HUMAN)
VSDLSRDIV

SEQ ID NO: 38247 - protein, 9 aa, Artificial Sequence
  Description of Artificial Sequence: Synthetic peptide
  Seed: AVYDLSRDI (KKLC1_HUMAN)
ALYDLSRDA

SEQ ID NO: 38248 - protein, 11 aa, Artificial Sequence
  Description of Artificial Sequence: Synthetic peptide
  Seed: SILCALIVFWK (KKLC1_HUMAN)
SSLCALIVFWR

SEQ ID NO: 38249 - protein, 10 aa, Artificial Sequence
  Description of Artificial Sequence: Synthetic peptide
  Seed: KYRRFQRNTG (KKLC1_HUMAN)
KARRFQRNTK

SEQ ID NO: 38250 - protein, 10 aa, Artificial Sequence
  Description of Artificial Sequence: Synthetic peptide
  Seed: SSNSTALALV (KKLC1_HUMAN)
SVNSTALALI

SEQ ID NO: 38251 - protein, 9 aa, Artificial Sequence
  Description of Artificial Sequence: Synthetic peptide
  Seed: MSSNSTALA (KKLC1_HUMAN)
MSSNSTALY

SEQ ID NO: 38252 - protein, 11 aa, Artificial Sequence
  Description of Artificial Sequence: Synthetic peptide
  Seed: RQKRILVNLSM (KKLC1_HUMAN)
RQKRILVNLSK

SEQ ID NO: 38253 - protein, 9 aa, Artificial Sequence
  Description of Artificial Sequence: Synthetic peptide
  Seed: LVRPSSSGL (KKLC1_HUMAN)
LMRPSSSGL

SEQ ID NO: 38254 - protein, 11 aa, Artificial Sequence
  Description of Artificial Sequence: Synthetic peptide
  Seed: RQKRILVNLSM (KKLC1_HUMAN)
RMKRILVNLSK

SEQ ID NO: 38255 - protein, 11 aa, Artificial Sequence
  Description of Artificial Sequence: Synthetic peptide
  Seed: RQKRILVNLSM (KKLC1_HUMAN)
RSKRILVNLSK

SEQ ID NO: 38256 - protein, 10 aa, Artificial Sequence
  Description of Artificial Sequence: Synthetic peptide
  Seed: KGFRGASPHR (KKLC1_HUMAN)
KLFRGASPHA

SEQ ID NO: 38257 - protein, 9 aa, Artificial Sequence
  Description of Artificial Sequence: Synthetic peptide
  Seed: SSNSTALAL (KKLC1_HUMAN)
SPNSTALAI

SEQ ID NO: 38258 - protein, 9 aa, Artificial Sequence
  Description of Artificial Sequence: Synthetic peptide
  Seed: LIVFWKYRR (KKLC1_HUMAN)
LGVFWKYRR

SEQ ID NO: 38259 - protein, 11 aa, Artificial Sequence
  Description of Artificial Sequence: Synthetic peptide
  Seed: MNFYLLLASSI (KKLC1_HUMAN)
MAFYLLLASSF

SEQ ID NO: 38260 - protein, 10 aa, Artificial Sequence
  Description of Artificial Sequence: Synthetic peptide
  Seed: QKRILVNLSM (KKLC1_HUMAN)
QKRILVNLSV

SEQ ID NO: 38261 - protein, 9 aa, Artificial Sequence
  Description of Artificial Sequence: Synthetic peptide
  Seed: RQKRILVNL (KKLC1_HUMAN)
RWKRILVNY

SEQ ID NO: 38262 - protein, 10 aa, Artificial Sequence
  Description of Artificial Sequence: Synthetic peptide
  Seed: SIARQKRILV (KKLC1_HUMAN)
SMARQKRILK

SEQ ID NO: 38263 - protein, 11 aa, Artificial Sequence
  Description of Artificial Sequence: Synthetic peptide
  Seed: RDILNNFPHSI (KKLC1_HUMAN)
RPILNNFPHSV

SEQ ID NO: 38264 - protein, 9 aa, Artificial Sequence
  Description of Artificial Sequence: Synthetic peptide
  Seed: NNFPHSIAR (KKLC1_HUMAN)
NLFPHSIAY

SEQ ID NO: 38265 - protein, 9 aa, Artificial Sequence
  Description of Artificial Sequence: Synthetic peptide
  Seed: NNFPHSIAR (KKLC1_HUMAN)
NMFPHSIAF

SEQ ID NO: 38266 - protein, 10 aa, Artificial Sequence
  Description of Artificial Sequence: Synthetic peptide
  Seed: LLLASSILCA (KKLC1_HUMAN)
LRLASSILCL

SEQ ID NO: 38267 - protein, 10 aa, Artificial Sequence
  Description of Artificial Sequence: Synthetic peptide
  Seed: YLLLASSILC (KKLC1_HUMAN)
YELLASSILV

SEQ ID NO: 38268 - protein, 9 aa, Artificial Sequence
  Description of Artificial Sequence: Synthetic peptide
  Seed: LLLASSILC (KKLC1_HUMAN)
LLLASSILM

SEQ ID NO: 38269 - protein, 9 aa, Artificial Sequence
  Description of Artificial Sequence: Synthetic peptide
  Seed: AVYDLSRDI (KKLC1_HUMAN)
AAYDLSRDI

SEQ ID NO: 38270 - protein, 10 aa, Artificial Sequence
  Description of Artificial Sequence: Synthetic peptide
  Seed: QKRILVNLSM (KKLC1_HUMAN)
QIRILVNLSM

SEQ ID NO: 38271 - protein, 9 aa, Artificial Sequence
  Description of Artificial Sequence: Synthetic peptide
  Seed: LASSILCAL (KKLC1_HUMAN)
LESSILCAY

SEQ ID NO: 38272 - protein, 10 aa, Artificial Sequence
  Description of Artificial Sequence: Synthetic peptide
  Seed: MSSNSTALAL (KKLC1_HUMAN)
MTSNSTALAV

SEQ ID NO: 38273 - protein, 9 aa, Artificial Sequence
  Description of Artificial Sequence: Synthetic peptide
  Seed: LVRPSSSGL (KKLC1_HUMAN)
LIRPSSSGF

SEQ ID NO: 38274 - protein, 10 aa, Artificial Sequence
  Description of Artificial Sequence: Synthetic peptide
  Seed: LLASSILCAL (KKLC1_HUMAN)
LTASSILCAI

SEQ ID NO: 38275 - protein, 9 aa, Artificial Sequence
  Description of Artificial Sequence: Synthetic peptide
  Seed: SNTDNNLAV (KKLC1_HUMAN)
SVTDNNLAV

SEQ ID NO: 38276 - protein, 10 aa, Artificial Sequence
  Description of Artificial Sequence: Synthetic peptide
  Seed: EHTLLSKGFR (KKLC1_HUMAN)
ERTLLSKGFR

SEQ ID NO: 38277 - protein, 9 aa, Artificial Sequence
  Description of Artificial Sequence: Synthetic peptide
  Seed: ILNNFPHSI (KKLC1_HUMAN)
IQNNFPHSI

SEQ ID NO: 38278 - protein, 10 aa, Artificial Sequence
  Description of Artificial Sequence: Synthetic peptide
  Seed: EHTLLSKGFR (KKLC1_HUMAN)
ETTLLSKGFR

SEQ ID NO: 38279 - protein, 9 aa, Artificial Sequence
  Description of Artificial Sequence: Synthetic peptide
  Seed: KLVELEHTL (KKLC1_HUMAN)
KTVELEHTY

SEQ ID NO: 38280 - protein, 10 aa, Artificial Sequence
  Description of Artificial Sequence: Synthetic peptide
  Seed: KYRRFQRNTG (KKLC1_HUMAN)
KVRRFQRNTM

SEQ ID NO: 38281 - protein, 8 aa, Artificial Sequence
  Description of Artificial Sequence: Synthetic peptide
  Seed: MSSNSTAL (KKLC1_HUMAN)
MSSNSTAM

SEQ ID NO: 38282 - protein, 9 aa, Artificial Sequence
  Description of Artificial Sequence: Synthetic peptide
  Seed: IARQKRILV (KKLC1_HUMAN)
ILRQKRILM

SEQ ID NO: 38283 - protein, 10 aa, Artificial Sequence
  Description of Artificial Sequence: Synthetic peptide
  Seed: QKRILVNLSM (KKLC1_HUMAN)
QWRILVNLSL

SEQ ID NO: 38284 - protein, 9 aa, Artificial Sequence
  Description of Artificial Sequence: Synthetic peptide
  Seed: NSTALALVR (KKLC1_HUMAN)
NTTALALVR

SEQ ID NO: 38285 - protein, 9 aa, Artificial Sequence
  Description of Artificial Sequence: Synthetic peptide
  Seed: LSRDILNNF (KKLC1_HUMAN)
LVRDILNNW

SEQ ID NO: 38286 - protein, 9 aa, Artificial Sequence
  Description of Artificial Sequence: Synthetic peptide
  Seed: MVENKLVEL (KKLC1_HUMAN)
MLENKLVEY

SEQ ID NO: 38287 - protein, 10 aa, Artificial Sequence
  Description of Artificial Sequence: Synthetic peptide
  Seed: KGFRGASPHR (KKLC1_HUMAN)
KWFRGASPHK

SEQ ID NO: 38288 - protein, 10 aa, Artificial Sequence
  Description of Artificial Sequence: Synthetic peptide
  Seed: YLLLASSILC (KKLC1_HUMAN)
YRLLASSILI

SEQ ID NO: 38289 - protein, 10 aa, Artificial Sequence
  Description of Artificial Sequence: Synthetic peptide
  Seed: SMVENKLVEL (KKLC1_HUMAN)
SAVENKLVEF

SEQ ID NO: 38290 - protein, 9 aa, Artificial Sequence
  Description of Artificial Sequence: Synthetic peptide
  Seed: MVENKLVEL (KKLC1_HUMAN)
MYENKLVEV

SEQ ID NO: 38291 - protein, 9 aa, Artificial Sequence
  Description of Artificial Sequence: Synthetic peptide
  Seed: RQKRILVNL (KKLC1_HUMAN)
RWKRILVNK

SEQ ID NO: 38292 - protein, 9 aa, Artificial Sequence
  Description of Artificial Sequence: Synthetic peptide
  Seed: NNFPHSIAR (KKLC1_HUMAN)
NRFPHSIAM

SEQ ID NO: 38293 - protein, 11 aa, Artificial Sequence
  Description of Artificial Sequence: Synthetic peptide
  Seed: LLLASSILCAL (KKLC1_HUMAN)
LFLASSILCAV

SEQ ID NO: 38294 - protein, 10 aa, Artificial Sequence
  Description of Artificial Sequence: Synthetic peptide
  Seed: MSSNSTALAL (KKLC1_HUMAN)
MYSNSTALAW

SEQ ID NO: 38295 - protein, 9 aa, Artificial Sequence
  Description of Artificial Sequence: Synthetic peptide
  Seed: SNTDNNLAV (KKLC1_HUMAN)
SATDNNLAY

SEQ ID NO: 38296 - protein, 8 aa, Artificial Sequence
  Description of Artificial Sequence: Synthetic peptide
  Seed: NTDNNLAV (KKLC1_HUMAN)
NWDNNLAM

SEQ ID NO: 38297 - protein, 11 aa, Artificial Sequence
  Description of Artificial Sequence: Synthetic peptide
  Seed: RDILNNFPHSI (KKLC1_HUMAN)
RQILNNFPHSV

SEQ ID NO: 38298 - protein, 10 aa, Artificial Sequence
  Description of Artificial Sequence: Synthetic peptide
  Seed: VELEHTLLSK (KKLC1_HUMAN)
VILEHTLLSR

SEQ ID NO: 38299 - protein, 9 aa, Artificial Sequence
  Description of Artificial Sequence: Synthetic peptide
  Seed: RRFQRNTGE (KKLC1_HUMAN)
RRFQRNTGR

SEQ ID NO: 38300 - protein, 9 aa, Artificial Sequence
  Description of Artificial Sequence: Synthetic peptide
  Seed: NTDNNLAVY (KKLC1_HUMAN)
NSDNNLAVY

SEQ ID NO: 38301 - protein, 9 aa, Artificial Sequence
  Description of Artificial Sequence: Synthetic peptide
  Seed: KRILVNLSM (KKLC1_HUMAN)
KRILVNLSV

SEQ ID NO: 38302 - protein, 10 aa, Artificial Sequence
  Description of Artificial Sequence: Synthetic peptide
  Seed: KGFRGASPHR (KKLC1_HUMAN)
KTFRGASPHL

SEQ ID NO: 38303 - protein, 10 aa, Artificial Sequence
  Description of Artificial Sequence: Synthetic peptide
  Seed: LLASSILCAL (KKLC1_HUMAN)
LVASSILCAI

SEQ ID NO: 38304 - protein, 9 aa, Artificial Sequence
  Description of Artificial Sequence: Synthetic peptide
  Seed: RQKRILVNL (KKLC1_HUMAN)
RAKRILVNY

SEQ ID NO: 38305 - protein, 10 aa, Artificial Sequence
  Description of Artificial Sequence: Synthetic peptide
  Seed: YLLLASSILC (KKLC1_HUMAN)
YYLLASSILV

SEQ ID NO: 38306 - protein, 9 aa, Artificial Sequence
  Description of Artificial Sequence: Synthetic peptide
  Seed: RQKRILVNL (KKLC1_HUMAN)
RSKRILVNC

SEQ ID NO: 38307 - protein, 9 aa, Artificial Sequence
  Description of Artificial Sequence: Synthetic peptide
  Seed: SSNSTALAL (KKLC1_HUMAN)
SVNSTALAF

SEQ ID NO: 38308 - protein, 11 aa, Artificial Sequence
  Description of Artificial Sequence: Synthetic peptide
  Seed: YLLLASSILCA (KKLC1_HUMAN)
YGLLASSILCI

SEQ ID NO: 38309 - protein, 10 aa, Artificial Sequence
  Description of Artificial Sequence: Synthetic peptide
  Seed: EHTLLSKGFR (KKLC1_HUMAN)
EATLLSKGFK

SEQ ID NO: 38310 - protein, 9 aa, Artificial Sequence
  Description of Artificial Sequence: Synthetic peptide
  Seed: SNTDNNLAV (KKLC1_HUMAN)
SSTDNNLAF

SEQ ID NO: 38311 - protein, 11 aa, Artificial Sequence
  Description of Artificial Sequence: Synthetic peptide
  Seed: YLLLASSILCA (KKLC1_HUMAN)
YRLLASSILCI

SEQ ID NO: 38312 - protein, 9 aa, Artificial Sequence
  Description of Artificial Sequence: Synthetic peptide
  Seed: KLVELEHTL (KKLC1_HUMAN)
KQVELEHTW

SEQ ID NO: 38313 - protein, 9 aa, Artificial Sequence
  Description of Artificial Sequence: Synthetic peptide
  Seed: KRILVNLSM (KKLC1_HUMAN)
KTILVNLSF

SEQ ID NO: 38314 - protein, 10 aa, Artificial Sequence
  Description of Artificial Sequence: Synthetic peptide
  Seed: SSNSTALALV (KKLC1_HUMAN)
SLNSTALALL

SEQ ID NO: 38315 - protein, 10 aa, Artificial Sequence
  Description of Artificial Sequence: Synthetic peptide
  Seed: KGFRGASPHR (KKLC1_HUMAN)
KAFRGASPHK

SEQ ID NO: 38316 - protein, 11 aa, Artificial Sequence
  Description of Artificial Sequence: Synthetic peptide
  Seed: RDILNNFPHSI (KKLC1_HUMAN)
RVILNNFPHSV

SEQ ID NO: 38317 - protein, 10 aa, Artificial Sequence
  Description of Artificial Sequence: Synthetic peptide
  Seed: LLLASSILCA (KKLC1_HUMAN)
LKLASSILCL

SEQ ID NO: 38318 - protein, 10 aa, Artificial Sequence
  Description of Artificial Sequence: Synthetic peptide
  Seed: ILNNFPHSIA (KKLC1_HUMAN)
ILNNFPHSIV

SEQ ID NO: 38319 - protein, 10 aa, Artificial Sequence
  Description of Artificial Sequence: Synthetic peptide
  Seed: LNNFPHSIAR (KKLC1_HUMAN)
LLNFPHSIAR

SEQ ID NO: 38320 - protein, 9 aa, Artificial Sequence
  Description of Artificial Sequence: Synthetic peptide
  Seed: FWKYRRFQR (KKLC1_HUMAN)
FMKYRRFQR

SEQ ID NO: 38321 - protein, 9 aa, Artificial Sequence
  Description of Artificial Sequence: Synthetic peptide
  Seed: ILNNFPHSI (KKLC1_HUMAN)
IGNNFPHSY

SEQ ID NO: 38322 - protein, 9 aa, Artificial Sequence
  Description of Artificial Sequence: Synthetic peptide
  Seed: GASPHRKST (KKLC1_HUMAN)
GTSPHRKSY

SEQ ID NO: 38323 - protein, 10 aa, Artificial Sequence
  Description of Artificial Sequence: Synthetic peptide
  Seed: GEMSSNSTAL (KKLC1_HUMAN)
GLMSSNSTAY

SEQ ID NO: 38324 - protein, 9 aa, Artificial Sequence
  Description of Artificial Sequence: Synthetic peptide
  Seed: NTDNNLAVY (KKLC1_HUMAN)
NADNNLAVL

SEQ ID NO: 38325 - protein, 9 aa, Artificial Sequence
  Description of Artificial Sequence: Synthetic peptide
  Seed: SILCALIVF (KKLC1_HUMAN)
SRLCALIVF

SEQ ID NO: 38326 - protein, 9 aa, Artificial Sequence
  Description of Artificial Sequence: Synthetic peptide
  Seed: IARQKRILV (KKLC1_HUMAN)
ITRQKRILW

SEQ ID NO: 38327 - protein, 11 aa, Artificial Sequence
  Description of Artificial Sequence: Synthetic peptide
  Seed: RQKRILVNLSM (KKLC1_HUMAN)
RWKRILVNLSK

SEQ ID NO: 38328 - protein, 9 aa, Artificial Sequence
  Description of Artificial Sequence: Synthetic peptide
  Seed: LVRPSSSGL (KKLC1_HUMAN)
LQRPSSSGY

SEQ ID NO: 38329 - protein, 9 aa, Artificial Sequence
  Description of Artificial Sequence: Synthetic peptide
  Seed: MVENKLVEL (KKLC1_HUMAN)
MTENKLVEV

SEQ ID NO: 38330 - protein, 9 aa, Artificial Sequence
  Description of Artificial Sequence: Synthetic peptide
  Seed: RRFQRNTGE (KKLC1_HUMAN)
RRFQRNTGY

SEQ ID NO: 38331 - protein, 10 aa, Artificial Sequence
  Description of Artificial Sequence: Synthetic peptide
  Seed: LLLASSILCA (KKLC1_HUMAN)
LFLASSILCI

SEQ ID NO: 38332 - protein, 9 aa, Artificial Sequence
  Description of Artificial Sequence: Synthetic peptide
  Seed: KLVELEHTL (KKLC1_HUMAN)
KIVELEHTL

SEQ ID NO: 38333 - protein, 9 aa, Artificial Sequence
  Description of Artificial Sequence: Synthetic peptide
  Seed: SNTDNNLAV (KKLC1_HUMAN)
SLTDNNLAL

SEQ ID NO: 38334 - protein, 9 aa, Artificial Sequence
  Description of Artificial Sequence: Synthetic peptide
  Seed: LVRPSSSGL (KKLC1_HUMAN)
LMRPSSSGY

SEQ ID NO: 38335 - protein, 9 aa, Artificial Sequence
  Description of Artificial Sequence: Synthetic peptide
  Seed: NLAVYDLSR (KKLC1_HUMAN)
NAAVYDLSL

SEQ ID NO: 38336 - protein, 9 aa, Artificial Sequence
  Description of Artificial Sequence: Synthetic peptide
  Seed: SNTDNNLAV (KKLC1_HUMAN)
SSTDNNLAY

SEQ ID NO: 38337 - protein, 9 aa, Artificial Sequence
  Description of Artificial Sequence: Synthetic peptide
  Seed: MVENKLVEL (KKLC1_HUMAN)
MDENKLVEF

SEQ ID NO: 38338 - protein, 9 aa, Artificial Sequence
  Description of Artificial Sequence: Synthetic peptide
  Seed: KYRRFQRNT (KKLC1_HUMAN)
KSRRFQRNR

SEQ ID NO: 38339 - protein, 9 aa, Artificial Sequence
  Description of Artificial Sequence: Synthetic peptide
  Seed: LVRPSSSGL (KKLC1_HUMAN)
LQRPSSSGM

SEQ ID NO: 38340 - protein, 9 aa, Artificial Sequence
  Description of Artificial Sequence: Synthetic peptide
  Seed: MSSNSTALA (KKLC1_HUMAN)
MTSNSTALF

SEQ ID NO: 38341 - protein, 9 aa, Artificial Sequence
  Description of Artificial Sequence: Synthetic peptide
  Seed: FWKYRRFQR (KKLC1_HUMAN)
FNKYRRFQR

SEQ ID NO: 38342 - protein, 9 aa, Artificial Sequence
  Description of Artificial Sequence: Synthetic peptide
  Seed: KGFRGASPH (KKLC1_HUMAN)
KYFRGASPF

SEQ ID NO: 38343 - protein, 11 aa, Artificial Sequence
  Description of Artificial Sequence: Synthetic peptide
  Seed: RQKRILVNLSM (KKLC1_HUMAN)
RLKRILVNLSM

SEQ ID NO: 38344 - protein, 11 aa, Artificial Sequence
  Description of Artificial Sequence: Synthetic peptide
  Seed: YLLLASSILCA (KKLC1_HUMAN)
YGLLASSILCV

SEQ ID NO: 38345 - protein, 9 aa, Artificial Sequence
  Description of Artificial Sequence: Synthetic peptide
  Seed: LLASSILCA (KKLC1_HUMAN)
LIASSILCL

SEQ ID NO: 38346 - protein, 9 aa, Artificial Sequence
  Description of Artificial Sequence: Synthetic peptide
  Seed: KGFRGASPH (KKLC1_HUMAN)
KTFRGASPM

SEQ ID NO: 38347 - protein, 9 aa, Artificial Sequence
  Description of Artificial Sequence: Synthetic peptide
  Seed: KLVELEHTL (KKLC1_HUMAN)
KEVELEHTI

SEQ ID NO: 38348 - protein, 10 aa, Artificial Sequence
  Description of Artificial Sequence: Synthetic peptide
  Seed: RQKRILVNLS (KKLC1_HUMAN)
RGKRILVNLK

SEQ ID NO: 38349 - protein, 10 aa, Artificial Sequence
  Description of Artificial Sequence: Synthetic peptide
  Seed: LLASSILCAL (KKLC1_HUMAN)
LAASSILCAL

SEQ ID NO: 38350 - protein, 9 aa, Artificial Sequence
  Description of Artificial Sequence: Synthetic peptide
  Seed: ILNNFPHSI (KKLC1_HUMAN)
ILNNFPHSA

SEQ ID NO: 38351 - protein, 11 aa, Artificial Sequence
  Description of Artificial Sequence: Synthetic peptide
  Seed: KLVELEHTLLS (KKLC1_HUMAN)
KIVELEHTLLV

SEQ ID NO: 38352 - protein, 10 aa, Artificial Sequence
  Description of Artificial Sequence: Synthetic peptide
  Seed: LLASSILCAL (KKLC1_HUMAN)
LLASSILCAM

SEQ ID NO: 38353 - protein, 9 aa, Artificial Sequence
  Description of Artificial Sequence: Synthetic peptide
  Seed: NTDNNLAVY (KKLC1_HUMAN)
NIDNNLAVL

SEQ ID NO: 38354 - protein, 9 aa, Artificial Sequence
  Description of Artificial Sequence: Synthetic peptide
  Seed: KLVELEHTL (KKLC1_HUMAN)
KDVELEHTL

SEQ ID NO: 38355 - protein, 9 aa, Artificial Sequence
  Description of Artificial Sequence: Synthetic peptide
  Seed: SNSTALALV (KKLC1_HUMAN)
SISTALALV

SEQ ID NO: 38356 - protein, 10 aa, Artificial Sequence
  Description of Artificial Sequence: Synthetic peptide
  Seed: LLLASSILCA (KKLC1_HUMAN)
LHLASSILCL

SEQ ID NO: 38357 - protein, 10 aa, Artificial Sequence
  Description of Artificial Sequence: Synthetic peptide
  Seed: DLSRDILNNF (KKLC1_HUMAN)
DVSRDILNNY

SEQ ID NO: 38358 - protein, 9 aa, Artificial Sequence
  Description of Artificial Sequence: Synthetic peptide
  Seed: SSNSTALAL (KKLC1_HUMAN)
SANSTALAY

SEQ ID NO: 38359 - protein, 9 aa, Artificial Sequence
  Description of Artificial Sequence: Synthetic peptide
  Seed: NNFPHSIAR (KKLC1_HUMAN)
NIFPHSIAH

SEQ ID NO: 38360 - protein, 11 aa, Artificial Sequence
  Description of Artificial Sequence: Synthetic peptide
  Seed: IVFWKYRRFQR (KKLC1_HUMAN)
IAFWKYRRFQR

SEQ ID NO: 38361 - protein, 9 aa, Artificial Sequence
  Description of Artificial Sequence: Synthetic peptide
  Seed: GEMSSNSTA (KKLC1_HUMAN)
GEMSSNSTF

SEQ ID NO: 38362 - protein, 9 aa, Artificial Sequence
  Description of Artificial Sequence: Synthetic peptide
  Seed: NNFPHSIAR (KKLC1_HUMAN)
NTFPHSIAY

SEQ ID NO: 38363 - protein, 9 aa, Artificial Sequence
  Description of Artificial Sequence: Synthetic peptide
  Seed: MVENKLVEL (KKLC1_HUMAN)
MMENKLVEI

SEQ ID NO: 38364 - protein, 9 aa, Artificial Sequence
  Description of Artificial Sequence: Synthetic peptide
  Seed: NNFPHSIAR (KKLC1_HUMAN)
NYFPHSIAM

SEQ ID NO: 38365 - protein, 9 aa, Artificial Sequence
  Description of Artificial Sequence: Synthetic peptide
  Seed: NLSMVENKL (KKLC1_HUMAN)
NMSMVENKL

SEQ ID NO: 38366 - protein, 9 aa, Artificial Sequence
  Description of Artificial Sequence: Synthetic peptide
  Seed: ILNNFPHSI (KKLC1_HUMAN)
ILNNFPHST

SEQ ID NO: 38367 - protein, 9 aa, Artificial Sequence
  Description of Artificial Sequence: Synthetic peptide
  Seed: MSSNSTALA (KKLC1_HUMAN)
MLSNSTALM

SEQ ID NO: 38368 - protein, 9 aa, Artificial Sequence
  Description of Artificial Sequence: Synthetic peptide
  Seed: LLLASSILC (KKLC1_HUMAN)
LMLASSILM

SEQ ID NO: 38369 - protein, 11 aa, Artificial Sequence
  Description of Artificial Sequence: Synthetic peptide
  Seed: MSSNSTALALV (KKLC1_HUMAN)
MTSNSTALALW

SEQ ID NO: 38370 - protein, 9 aa, Artificial Sequence
  Description of Artificial Sequence: Synthetic peptide
  Seed: EMSSNSTAL (KKLC1_HUMAN)
EVSSNSTAY

SEQ ID NO: 38371 - protein, 9 aa, Artificial Sequence
  Description of Artificial Sequence: Synthetic peptide
  Seed: IARQKRILV (KKLC1_HUMAN)
IARQKRILL

SEQ ID NO: 38372 - protein, 10 aa, Artificial Sequence
  Description of Artificial Sequence: Synthetic peptide
  Seed: LNNFPHSIAR (KKLC1_HUMAN)
LFNFPHSIAR

SEQ ID NO: 38373 - protein, 9 aa, Artificial Sequence
  Description of Artificial Sequence: Synthetic peptide
  Seed: CALIVFWKY (KKLC1_HUMAN)
CQLIVFWKY

SEQ ID NO: 38374 - protein, 9 aa, Artificial Sequence
  Description of Artificial Sequence: Synthetic peptide
  Seed: RQKRILVNL (KKLC1_HUMAN)
RSKRILVNS

SEQ ID NO: 38375 - protein, 10 aa, Artificial Sequence
  Description of Artificial Sequence: Synthetic peptide
  Seed: SSNSTALALV (KKLC1_HUMAN)
SVNSTALALV

SEQ ID NO: 38376 - protein, 11 aa, Artificial Sequence
  Description of Artificial Sequence: Synthetic peptide
  Seed: KGFRGASPHRK (KKLC1_HUMAN)
KIFRGASPHRR

SEQ ID NO: 38377 - protein, 9 aa, Artificial Sequence
  Description of Artificial Sequence: Synthetic peptide
  Seed: LVRPSSSGL (KKLC1_HUMAN)
LMRPSSSGV

SEQ ID NO: 38378 - protein, 9 aa, Artificial Sequence
  Description of Artificial Sequence: Synthetic peptide
  Seed: NNFPHSIAR (KKLC1_HUMAN)
NAFPHSIAV

SEQ ID NO: 38379 - protein, 10 aa, Artificial Sequence
  Description of Artificial Sequence: Synthetic peptide
  Seed: SSNSTALALV (KKLC1_HUMAN)
SMNSTALALV

SEQ ID NO: 38380 - protein, 10 aa, Artificial Sequence
  Description of Artificial Sequence: Synthetic peptide
  Seed: FYLLLASSIL (KKLC1_HUMAN)
FYLLLASSII

SEQ ID NO: 38381 - protein, 9 aa, Artificial Sequence
  Description of Artificial Sequence: Synthetic peptide
  Seed: ILNNFPHSI (KKLC1_HUMAN)
IRNNFPHSF

SEQ ID NO: 38382 - protein, 11 aa, Artificial Sequence
  Description of Artificial Sequence: Synthetic peptide
  Seed: RQKRILVNLSM (KKLC1_HUMAN)
RRKRILVNLSK

SEQ ID NO: 38383 - protein, 10 aa, Artificial Sequence
  Description of Artificial Sequence: Synthetic peptide
  Seed: GEMSSNSTAL (KKLC1_HUMAN)
GVMSSNSTAV

SEQ ID NO: 38384 - protein, 9 aa, Artificial Sequence
  Description of Artificial Sequence: Synthetic peptide
  Seed: SSNSTALAL (KKLC1_HUMAN)
SANSTALAI

SEQ ID NO: 38385 - protein, 10 aa, Artificial Sequence
  Description of Artificial Sequence: Synthetic peptide
  Seed: SKGFRGASPH (KKLC1_HUMAN)
SMGFRGASPF

SEQ ID NO: 38386 - protein, 10 aa, Artificial Sequence
  Description of Artificial Sequence: Synthetic peptide
  Seed: RRFQRNTGEM (KKLC1_HUMAN)
RSFQRNTGEY

SEQ ID NO: 38387 - protein, 9 aa, Artificial Sequence
  Description of Artificial Sequence: Synthetic peptide
  Seed: ILCALIVFW (KKLC1_HUMAN)
ISCALIVFF

SEQ ID NO: 38388 - protein, 9 aa, Artificial Sequence
  Description of Artificial Sequence: Synthetic peptide
  Seed: RRFQRNTGE (KKLC1_HUMAN)
RRFQRNTGK

SEQ ID NO: 38389 - protein, 9 aa, Artificial Sequence
  Description of Artificial Sequence: Synthetic peptide
  Seed: SILCALIVF (KKLC1_HUMAN)
SSLCALIVF

SEQ ID NO: 38390 - protein, 10 aa, Artificial Sequence
  Description of Artificial Sequence: Synthetic peptide
  Seed: NKLVELEHTL (KKLC1_HUMAN)
NFLVELEHTL

SEQ ID NO: 38391 - protein, 9 aa, Artificial Sequence
  Description of Artificial Sequence: Synthetic peptide
  Seed: SNTDNNLAV (KKLC1_HUMAN)
SMTDNNLAI

SEQ ID NO: 38392 - protein, 10 aa, Artificial Sequence
  Description of Artificial Sequence: Synthetic peptide
  Seed: SSNSTALALV (KKLC1_HUMAN)
STNSTALALV

SEQ ID NO: 38393 - protein, 9 aa, Artificial Sequence
  Description of Artificial Sequence: Synthetic peptide
  Seed: RQKRILVNL (KKLC1_HUMAN)
RFKRILVNK

SEQ ID NO: 38394 - protein, 10 aa, Artificial Sequence
  Description of Artificial Sequence: Synthetic peptide
  Seed: MSSNSTALAL (KKLC1_HUMAN)
MWSNSTALAY

SEQ ID NO: 38395 - protein, 9 aa, Artificial Sequence
  Description of Artificial Sequence: Synthetic peptide
  Seed: NNFPHSIAR (KKLC1_HUMAN)
NFFPHSIAL

SEQ ID NO: 38396 - protein, 11 aa, Artificial Sequence
  Description of Artificial Sequence: Synthetic peptide
  Seed: KLVELEHTLLS (KKLC1_HUMAN)
KLVELEHTLLV

SEQ ID NO: 38397 - protein, 10 aa, Artificial Sequence
  Description of Artificial Sequence: Synthetic peptide
  Seed: SKGFRGASPH (KKLC1_HUMAN)
SYGFRGASPF

SEQ ID NO: 38398 - protein, 10 aa, Artificial Sequence
  Description of Artificial Sequence: Synthetic peptide
  Seed: KGFRGASPHR (KKLC1_HUMAN)
KTFRGASPHA

SEQ ID NO: 38399 - protein, 11 aa, Artificial Sequence
  Description of Artificial Sequence: Synthetic peptide
  Seed: KGFRGASPHRK (KKLC1_HUMAN)
KSFRGASPHRR

SEQ ID NO: 38400 - protein, 9 aa, Artificial Sequence
  Description of Artificial Sequence: Synthetic peptide
  Seed: LIVFWKYRR (KKLC1_HUMAN)
LYVFWKYRR

SEQ ID NO: 38401 - protein, 10 aa, Artificial Sequence
  Description of Artificial Sequence: Synthetic peptide
  Seed: YLLLASSILC (KKLC1_HUMAN)
YDLLASSILI

SEQ ID NO: 38402 - protein, 10 aa, Artificial Sequence
  Description of Artificial Sequence: Synthetic peptide
  Seed: LASSILCALI (KKLC1_HUMAN)
LMSSILCALP

SEQ ID NO: 38403 - protein, 9 aa, Artificial Sequence
  Description of Artificial Sequence: Synthetic peptide
  Seed: AVYDLSRDI (KKLC1_HUMAN)
ARYDLSRDM

SEQ ID NO: 38404 - protein, 9 aa, Artificial Sequence
  Description of Artificial Sequence: Synthetic peptide
  Seed: MVENKLVEL (KKLC1_HUMAN)
MPENKLVEM

SEQ ID NO: 38405 - protein, 10 aa, Artificial Sequence
  Description of Artificial Sequence: Synthetic peptide
  Seed: GEMSSNSTAL (KKLC1_HUMAN)
GMMSSNSTAM

SEQ ID NO: 38406 - protein, 9 aa, Artificial Sequence
  Description of Artificial Sequence: Synthetic peptide
  Seed: KYRRFQRNT (KKLC1_HUMAN)
KARRFQRNM

SEQ ID NO: 38407 - protein, 11 aa, Artificial Sequence
  Description of Artificial Sequence: Synthetic peptide
  Seed: MNFYLLLASSI (KKLC1_HUMAN)
MEFYLLLASSF

SEQ ID NO: 38408 - protein, 9 aa, Artificial Sequence
  Description of Artificial Sequence: Synthetic peptide
  Seed: NLSMVENKL (KKLC1_HUMAN)
NQSMVENKL

SEQ ID NO: 38409 - protein, 10 aa, Artificial Sequence
  Description of Artificial Sequence: Synthetic peptide
  Seed: DILNNFPHSI (KKLC1_HUMAN)
DTLNNFPHSL

SEQ ID NO: 38410 - protein, 9 aa, Artificial Sequence
  Description of Artificial Sequence: Synthetic peptide
  Seed: YLLLASSIL (KKLC1_HUMAN)
YALLASSIV

SEQ ID NO: 38411 - protein, 10 aa, Artificial Sequence
  Description of Artificial Sequence: Synthetic peptide
  Seed: VFWKYRRFQR (KKLC1_HUMAN)
VFWKYRRFQK

SEQ ID NO: 38412 - protein, 9 aa, Artificial Sequence
  Description of Artificial Sequence: Synthetic peptide
  Seed: ILCALIVFW (KKLC1_HUMAN)
ITCALIVFY

SEQ ID NO: 38413 - protein, 8 aa, Artificial Sequence
  Description of Artificial Sequence: Synthetic peptide
  Seed: VYDLSRDI (KKLC1_HUMAN)
VSDLSRDI

SEQ ID NO: 38414 - protein, 9 aa, Artificial Sequence
  Description of Artificial Sequence: Synthetic peptide
  Seed: ALIVFWKYR (KKLC1_HUMAN)
AYIVFWKYR

SEQ ID NO: 38415 - protein, 9 aa, Artificial Sequence
  Description of Artificial Sequence: Synthetic peptide
  Seed: MSSNSTALA (KKLC1_HUMAN)
MTSNSTALL

SEQ ID NO: 38416 - protein, 9 aa, Artificial Sequence
  Description of Artificial Sequence: Synthetic peptide
  Seed: SNSTALALV (KKLC1_HUMAN)
SVSTALALI

SEQ ID NO: 38417 - protein, 8 aa, Artificial Sequence
  Description of Artificial Sequence: Synthetic peptide
  Seed: IVFWKYRR (KKLC1_HUMAN)
IMFWKYRR

SEQ ID NO: 38418 - protein, 10 aa, Artificial Sequence
  Description of Artificial Sequence: Synthetic peptide
  Seed: EMSSNSTALA (KKLC1_HUMAN)
EVSSNSTALL

SEQ ID NO: 38419 - protein, 10 aa, Artificial Sequence
  Description of Artificial Sequence: Synthetic peptide
  Seed: LNNFPHSIAR (KKLC1_HUMAN)
LMNFPHSIAR

SEQ ID NO: 38420 - protein, 9 aa, Artificial Sequence
  Description of Artificial Sequence: Synthetic peptide
  Seed: KLVELEHTL (KKLC1_HUMAN)
KYVELEHTY

SEQ ID NO: 38421 - protein, 9 aa, Artificial Sequence
  Description of Artificial Sequence: Synthetic peptide
  Seed: LSMVENKLV (KKLC1_HUMAN)
LTMVENKLW

SEQ ID NO: 38422 - protein, 9 aa, Artificial Sequence
  Description of Artificial Sequence: Synthetic peptide
  Seed: KGFRGASPH (KKLC1_HUMAN)
KHFRGASPY

SEQ ID NO: 38423 - protein, 9 aa, Artificial Sequence
  Description of Artificial Sequence: Synthetic peptide
  Seed: LSRDILNNF (KKLC1_HUMAN)
LLRDILNNF

SEQ ID NO: 38424 - protein, 9 aa, Artificial Sequence
  Description of Artificial Sequence: Synthetic peptide
  Seed: NTDNNLAVY (KKLC1_HUMAN)
NMDNNLAVF

SEQ ID NO: 38425 - protein, 9 aa, Artificial Sequence
  Description of Artificial Sequence: Synthetic peptide
  Seed: KYRRFQRNT (KKLC1_HUMAN)
KVRRFQRNY

SEQ ID NO: 38426 - protein, 9 aa, Artificial Sequence
  Description of Artificial Sequence: Synthetic peptide
  Seed: YLLLASSIL (KKLC1_HUMAN)
YYLLASSII

SEQ ID NO: 38427 - protein, 10 aa, Artificial Sequence
  Description of Artificial Sequence: Synthetic peptide
  Seed: SMVENKLVEL (KKLC1_HUMAN)
SYVENKLVEY

SEQ ID NO: 38428 - protein, 9 aa, Artificial Sequence
  Description of Artificial Sequence: Synthetic peptide
  Seed: HSIARQKRI (KKLC1_HUMAN)
HAIARQKRY

SEQ ID NO: 38429 - protein, 11 aa, Artificial Sequence
  Description of Artificial Sequence: Synthetic peptide
  Seed: YLLLASSILCA (KKLC1_HUMAN)
YSLLASSILCL

SEQ ID NO: 38430 - protein, 10 aa, Artificial Sequence
  Description of Artificial Sequence: Synthetic peptide
  Seed: KGFRGASPHR (KKLC1_HUMAN)
KRFRGASPHK

SEQ ID NO: 38431 - protein, 9 aa, Artificial Sequence
  Description of Artificial Sequence: Synthetic peptide
  Seed: LCALIVFWK (KKLC1_HUMAN)
LVALIVFWK

SEQ ID NO: 38432 - protein, 9 aa, Artificial Sequence
  Description of Artificial Sequence: Synthetic peptide
  Seed: KRILVNLSM (KKLC1_HUMAN)
KSILVNLSM

SEQ ID NO: 38433 - protein, 10 aa, Artificial Sequence
  Description of Artificial Sequence: Synthetic peptide
  Seed: LASSILCALI (KKLC1_HUMAN)
LESSILCALW

SEQ ID NO: 38434 - protein, 9 aa, Artificial Sequence
  Description of Artificial Sequence: Synthetic peptide
  Seed: LIVFWKYRR (KKLC1_HUMAN)
LVVFWKYRK

SEQ ID NO: 38435 - protein, 9 aa, Artificial Sequence
  Description of Artificial Sequence: Synthetic peptide
  Seed: RQKRILVNL (KKLC1_HUMAN)
RVKRILVNT

SEQ ID NO: 38436 - protein, 9 aa, Artificial Sequence
  Description of Artificial Sequence: Synthetic peptide
  Seed: ILNNFPHSI (KKLC1_HUMAN)
IQNNFPHSV

SEQ ID NO: 38437 - protein, 9 aa, Artificial Sequence
  Description of Artificial Sequence: Synthetic peptide
  Seed: RQKRILVNL (KKLC1_HUMAN)
RMKRILVNF

SEQ ID NO: 38438 - protein, 10 aa, Artificial Sequence
  Description of Artificial Sequence: Synthetic peptide
  Seed: MSSNSTALAL (KKLC1_HUMAN)
MMSNSTALAV

SEQ ID NO: 38439 - protein, 9 aa, Artificial Sequence
  Description of Artificial Sequence: Synthetic peptide
  Seed: KRILVNLSM (KKLC1_HUMAN)
KKILVNLSM

SEQ ID NO: 38440 - protein, 10 aa, Artificial Sequence
  Description of Artificial Sequence: Synthetic peptide
  Seed: YLLLASSILC (KKLC1_HUMAN)
YWLLASSILM

SEQ ID NO: 38441 - protein, 9 aa, Artificial Sequence
  Description of Artificial Sequence: Synthetic peptide
  Seed: LASSILCAL (KKLC1_HUMAN)
LPSSILCAT

SEQ ID NO: 38442 - protein, 9 aa, Artificial Sequence
  Description of Artificial Sequence: Synthetic peptide
  Seed: SSNSTALAL (KKLC1_HUMAN)
SPNSTALAM

SEQ ID NO: 38443 - protein, 9 aa, Artificial Sequence
  Description of Artificial Sequence: Synthetic peptide
  Seed: KRILVNLSM (KKLC1_HUMAN)
KNILVNLSY

SEQ ID NO: 38444 - protein, 9 aa, Artificial Sequence
  Description of Artificial Sequence: Synthetic peptide
  Seed: ILNNFPHSI (KKLC1_HUMAN)
IYNNFPHSW

SEQ ID NO: 38445 - protein, 10 aa, Artificial Sequence
  Description of Artificial Sequence: Synthetic peptide
  Seed: SIARQKRILV (KKLC1_HUMAN)
SSARQKRILK

SEQ ID NO: 38446 - protein, 9 aa, Artificial Sequence
  Description of Artificial Sequence: Synthetic peptide
  Seed: GFRGASPHR (KKLC1_HUMAN)
GYRGASPHR

SEQ ID NO: 38447 - protein, 10 aa, Artificial Sequence
  Description of Artificial Sequence: Synthetic peptide
  Seed: QKRILVNLSM (KKLC1_HUMAN)
QLRILVNLSF

SEQ ID NO: 38448 - protein, 10 aa, Artificial Sequence
  Description of Artificial Sequence: Synthetic peptide
  Seed: SKGFRGASPH (KKLC1_HUMAN)
SVGFRGASPY

SEQ ID NO: 38449 - protein, 10 aa, Artificial Sequence
  Description of Artificial Sequence: Synthetic peptide
  Seed: YLLLASSILC (KKLC1_HUMAN)
YRLLASSILL

SEQ ID NO: 38450 - protein, 9 aa, Artificial Sequence
  Description of Artificial Sequence: Synthetic peptide
  Seed: RFQRNTGEM (KKLC1_HUMAN)
RYQRNTGEF

SEQ ID NO: 38451 - protein, 10 aa, Artificial Sequence
  Description of Artificial Sequence: Synthetic peptide
  Seed: LVRPSSSGLI (KKLC1_HUMAN)
LARPSSSGLK

SEQ ID NO: 38452 - protein, 11 aa, Artificial Sequence
  Description of Artificial Sequence: Synthetic peptide
  Seed: RQKRILVNLSM (KKLC1_HUMAN)
REKRILVNLSL

SEQ ID NO: 38453 - protein, 9 aa, Artificial Sequence
  Description of Artificial Sequence: Synthetic peptide
  Seed: NNFPHSIAR (KKLC1_HUMAN)
NMFPHSIAM

SEQ ID NO: 38454 - protein, 10 aa, Artificial Sequence
  Description of Artificial Sequence: Synthetic peptide
  Seed: SMVENKLVEL (KKLC1_HUMAN)
SYVENKLVEF

SEQ ID NO: 38455 - protein, 9 aa, Artificial Sequence
  Description of Artificial Sequence: Synthetic peptide
  Seed: RFQRNTGEM (KKLC1_HUMAN)
RWQRNTGEF

SEQ ID NO: 38456 - protein, 10 aa, Artificial Sequence
  Description of Artificial Sequence: Synthetic peptide
  Seed: SSILCALIVF (KKLC1_HUMAN)
SQILCALIVF

SEQ ID NO: 38457 - protein, 10 aa, Artificial Sequence
  Description of Artificial Sequence: Synthetic peptide
  Seed: VFWKYRRFQR (KKLC1_HUMAN)
VNWKYRRFQR

SEQ ID NO: 38458 - protein, 10 aa, Artificial Sequence
  Description of Artificial Sequence: Synthetic peptide
  Seed: YLLLASSILC (KKLC1_HUMAN)
YSLLASSILI

SEQ ID NO: 38459 - protein, 11 aa, Artificial Sequence
  Description of Artificial Sequence: Synthetic peptide
  Seed: RQKRILVNLSM (KKLC1_HUMAN)
RWKRILVNLSR

SEQ ID NO: 38460 - protein, 9 aa, Artificial Sequence
  Description of Artificial Sequence: Synthetic peptide
  Seed: NLSMVENKL (KKLC1_HUMAN)
NQSMVENKM

SEQ ID NO: 38461 - protein, 10 aa, Artificial Sequence
  Description of Artificial Sequence: Synthetic peptide
  Seed: ALIVFWKYRR (KKLC1_HUMAN)
AQIVFWKYRR

SEQ ID NO: 38462 - protein, 11 aa, Artificial Sequence
  Description of Artificial Sequence: Synthetic peptide
  Seed: RDILNNFPHSI (KKLC1_HUMAN)
RWILNNFPHSV

SEQ ID NO: 38463 - protein, 8 aa, Artificial Sequence
  Description of Artificial Sequence: Synthetic peptide
  Seed: VYDLSRDI (KKLC1_HUMAN)
VSDLSRDF

SEQ ID NO: 38464 - protein, 9 aa, Artificial Sequence
  Description of Artificial Sequence: Synthetic peptide
  Seed: LASSILCAL (KKLC1_HUMAN)
LASSILCAY

SEQ ID NO: 38465 - protein, 9 aa, Artificial Sequence
  Description of Artificial Sequence: Synthetic peptide
  Seed: ILNNFPHSI (KKLC1_HUMAN)
IMNNFPHSW

SEQ ID NO: 38466 - protein, 9 aa, Artificial Sequence
  Description of Artificial Sequence: Synthetic peptide
  Seed: HTLLSKGFR (KKLC1_HUMAN)
HFLLSKGFR

SEQ ID NO: 38467 - protein, 9 aa, Artificial Sequence
  Description of Artificial Sequence: Synthetic peptide
  Seed: RQKRILVNL (KKLC1_HUMAN)
RVKRILVNN

SEQ ID NO: 38468 - protein, 9 aa, Artificial Sequence
  Description of Artificial Sequence: Synthetic peptide
  Seed: SSNSTALAL (KKLC1_HUMAN)
SQNSTALAM

SEQ ID NO: 38469 - protein, 10 aa, Artificial Sequence
  Description of Artificial Sequence: Synthetic peptide
  Seed: GEMSSNSTAL (KKLC1_HUMAN)
GFMSSNSTAF

SEQ ID NO: 38470 - protein, 10 aa, Artificial Sequence
  Description of Artificial Sequence: Synthetic peptide
  Seed: MSSNSTALAL (KKLC1_HUMAN)
MLSNSTALAL

SEQ ID NO: 38471 - protein, 9 aa, Artificial Sequence
  Description of Artificial Sequence: Synthetic peptide
  Seed: LASSILCAL (KKLC1_HUMAN)
LVSSILCAA

SEQ ID NO: 38472 - protein, 10 aa, Artificial Sequence
  Description of Artificial Sequence: Synthetic peptide
  Seed: YLLLASSILC (KKLC1_HUMAN)
YLLLASSILM

SEQ ID NO: 38473 - protein, 9 aa, Artificial Sequence
  Description of Artificial Sequence: Synthetic peptide
  Seed: RQKRILVNL (KKLC1_HUMAN)
RIKRILVNY

SEQ ID NO: 38474 - protein, 9 aa, Artificial Sequence
  Description of Artificial Sequence: Synthetic peptide
  Seed: SSNSTALAL (KKLC1_HUMAN)
SSNSTALAI

SEQ ID NO: 38475 - protein, 9 aa, Artificial Sequence
  Description of Artificial Sequence: Synthetic peptide
  Seed: KYRRFQRNT (KKLC1_HUMAN)
KSRRFQRNG

SEQ ID NO: 38476 - protein, 10 aa, Artificial Sequence
  Description of Artificial Sequence: Synthetic peptide
  Seed: EHTLLSKGFR (KKLC1_HUMAN)
EFTLLSKGFR

SEQ ID NO: 38477 - protein, 11 aa, Artificial Sequence
  Description of Artificial Sequence: Synthetic peptide
  Seed: RQKRILVNLSM (KKLC1_HUMAN)
RIKRILVNLSR

SEQ ID NO: 38478 - protein, 9 aa, Artificial Sequence
  Description of Artificial Sequence: Synthetic peptide
  Seed: KLVELEHTL (KKLC1_HUMAN)
KAVELEHTY

SEQ ID NO: 38479 - protein, 9 aa, Artificial Sequence
  Description of Artificial Sequence: Synthetic peptide
  Seed: KRILVNLSM (KKLC1_HUMAN)
KRILVNLSI

SEQ ID NO: 38480 - protein, 10 aa, Artificial Sequence
  Description of Artificial Sequence: Synthetic peptide
  Seed: YLLLASSILC (KKLC1_HUMAN)
YMLLASSILL

SEQ ID NO: 38481 - protein, 10 aa, Artificial Sequence
  Description of Artificial Sequence: Synthetic peptide
  Seed: RQKRILVNLS (KKLC1_HUMAN)
RFKRILVNLK

SEQ ID NO: 38482 - protein, 9 aa, Artificial Sequence
  Description of Artificial Sequence: Synthetic peptide
  Seed: KGFRGASPH (KKLC1_HUMAN)
KHFRGASPF

SEQ ID NO: 38483 - protein, 10 aa, Artificial Sequence
  Description of Artificial Sequence: Synthetic peptide
  Seed: MSSNSTALAL (KKLC1_HUMAN)
MQSNSTALAM

SEQ ID NO: 38484 - protein, 10 aa, Artificial Sequence
  Description of Artificial Sequence: Synthetic peptide
  Seed: MSSNSTALAL (KKLC1_HUMAN)
MGSNSTALAM

SEQ ID NO: 38485 - protein, 11 aa, Artificial Sequence
  Description of Artificial Sequence: Synthetic peptide
  Seed: YLLLASSILCA (KKLC1_HUMAN)
YELLASSILCI

SEQ ID NO: 38486 - protein, 9 aa, Artificial Sequence
  Description of Artificial Sequence: Synthetic peptide
  Seed: LSRDILNNF (KKLC1_HUMAN)
LMRDILNNF

SEQ ID NO: 38487 - protein, 11 aa, Artificial Sequence
  Description of Artificial Sequence: Synthetic peptide
  Seed: SILCALIVFWK (KKLC1_HUMAN)
SFLCALIVFWR

SEQ ID NO: 38488 - protein, 9 aa, Artificial Sequence
  Description of Artificial Sequence: Synthetic peptide
  Seed: MVENKLVEL (KKLC1_HUMAN)
MWENKLVEL

SEQ ID NO: 38489 - protein, 9 aa, Artificial Sequence
  Description of Artificial Sequence: Synthetic peptide
  Seed: SNTDNNLAV (KKLC1_HUMAN)
SVTDNNLAY

SEQ ID NO: 38490 - protein, 10 aa, Artificial Sequence
  Description of Artificial Sequence: Synthetic peptide
  Seed: SKGFRGASPH (KKLC1_HUMAN)
SQGFRGASPW

SEQ ID NO: 38491 - protein, 9 aa, Artificial Sequence
  Description of Artificial Sequence: Synthetic peptide
  Seed: LLLASSILC (KKLC1_HUMAN)
LLLASSILL

SEQ ID NO: 38492 - protein, 9 aa, Artificial Sequence
  Description of Artificial Sequence: Synthetic peptide
  Seed: ALIVFWKYR (KKLC1_HUMAN)
ANIVFWKYR

SEQ ID NO: 38493 - protein, 9 aa, Artificial Sequence
  Description of Artificial Sequence: Synthetic peptide
  Seed: KGFRGASPH (KKLC1_HUMAN)
KFFRGASPM

SEQ ID NO: 38494 - protein, 9 aa, Artificial Sequence
  Description of Artificial Sequence: Synthetic peptide
  Seed: NNFPHSIAR (KKLC1_HUMAN)
NRFPHSIAY

SEQ ID NO: 38495 - protein, 11 aa, Artificial Sequence
  Description of Artificial Sequence: Synthetic peptide
  Seed: LLLASSILCAL (KKLC1_HUMAN)
LSLASSILCAV

SEQ ID NO: 38496 - protein, 9 aa, Artificial Sequence
  Description of Artificial Sequence: Synthetic peptide
  Seed: SNSTALALV (KKLC1_HUMAN)
SMSTALALA

SEQ ID NO: 38497 - protein, 11 aa, Artificial Sequence
  Description of Artificial Sequence: Synthetic peptide
  Seed: IVFWKYRRFQR (KKLC1_HUMAN)
IGFWKYRRFQR

SEQ ID NO: 38498 - protein, 10 aa, Artificial Sequence
  Description of Artificial Sequence: Synthetic peptide
  Seed: LNNFPHSIAR (KKLC1_HUMAN)
LMNFPHSIAK

SEQ ID NO: 38499 - protein, 9 aa, Artificial Sequence
  Description of Artificial Sequence: Synthetic peptide
  Seed: ILNNFPHSI (KKLC1_HUMAN)
IINNFPHSV

SEQ ID NO: 38500 - protein, 9 aa, Artificial Sequence
  Description of Artificial Sequence: Synthetic peptide
  Seed: LVRPSSSGL (KKLC1_HUMAN)
LTRPSSSGW

SEQ ID NO: 38501 - protein, 9 aa, Artificial Sequence
  Description of Artificial Sequence: Synthetic peptide
  Seed: RQKRILVNL (KKLC1_HUMAN)
RMKRILVNV

SEQ ID NO: 38502 - protein, 11 aa, Artificial Sequence
  Description of Artificial Sequence: Synthetic peptide
  Seed: RRFQRNTGEMS (KKLC1_HUMAN)
RRFQRNTGEMW

SEQ ID NO: 38503 - protein, 10 aa, Artificial Sequence
  Description of Artificial Sequence: Synthetic peptide
  Seed: LLLASSILCA (KKLC1_HUMAN)
LVLASSILCL

SEQ ID NO: 38504 - protein, 10 aa, Artificial Sequence
  Description of Artificial Sequence: Synthetic peptide
  Seed: LLLASSILCA (KKLC1_HUMAN)
LELASSILCV

SEQ ID NO: 38505 - protein, 9 aa, Artificial Sequence
  Description of Artificial Sequence: Synthetic peptide
  Seed: MVENKLVEL (KKLC1_HUMAN)
MFENKLVEF

SEQ ID NO: 38506 - protein, 9 aa, Artificial Sequence
  Description of Artificial Sequence: Synthetic peptide
  Seed: LVELEHTLL (KKLC1_HUMAN)
LWELEHTLL

SEQ ID NO: 38507 - protein, 10 aa, Artificial Sequence
  Description of Artificial Sequence: Synthetic peptide
  Seed: LLASSILCAL (KKLC1_HUMAN)
LLASSILCAV

SEQ ID NO: 38508 - protein, 9 aa, Artificial Sequence
  Description of Artificial Sequence: Synthetic peptide
  Seed: GEMSSNSTA (KKLC1_HUMAN)
GEMSSNSTC

SEQ ID NO: 38509 - protein, 9 aa, Artificial Sequence
  Description of Artificial Sequence: Synthetic peptide
  Seed: MSSNSTALA (KKLC1_HUMAN)
MSSNSTALL

SEQ ID NO: 38510 - protein, 9 aa, Artificial Sequence
  Description of Artificial Sequence: Synthetic peptide
  Seed: LASSILCAL (KKLC1_HUMAN)
LPSSILCAA

SEQ ID NO: 38511 - protein, 10 aa, Artificial Sequence
  Description of Artificial Sequence: Synthetic peptide
  Seed: QKRILVNLSM (KKLC1_HUMAN)
QYRILVNLSI

SEQ ID NO: 38512 - protein, 9 aa, Artificial Sequence
  Description of Artificial Sequence: Synthetic peptide
  Seed: RQKRILVNL (KKLC1_HUMAN)
RMKRILVNM

SEQ ID NO: 38513 - protein, 10 aa, Artificial Sequence
  Description of Artificial Sequence: Synthetic peptide
  Seed: SMVENKLVEL (KKLC1_HUMAN)
SIVENKLVEI

SEQ ID NO: 38514 - protein, 8 aa, Artificial Sequence
  Description of Artificial Sequence: Synthetic peptide
  Seed: NTDNNLAV (KKLC1_HUMAN)
NGDNNLAL

SEQ ID NO: 38515 - protein, 9 aa, Artificial Sequence
  Description of Artificial Sequence: Synthetic peptide
  Seed: VYDLSRDIL (KKLC1_HUMAN)
VYDLSRDIF

SEQ ID NO: 38516 - protein, 10 aa, Artificial Sequence
  Description of Artificial Sequence: Synthetic peptide
  Seed: MSSNSTALAL (KKLC1_HUMAN)
MHSNSTALAM

SEQ ID NO: 38517 - protein, 9 aa, Artificial Sequence
  Description of Artificial Sequence: Synthetic peptide
  Seed: SSNSTALAL (KKLC1_HUMAN)
SLNSTALAL

SEQ ID NO: 38518 - protein, 10 aa, Artificial Sequence
  Description of Artificial Sequence: Synthetic peptide
  Seed: LLASSILCAL (KKLC1_HUMAN)
LIASSILCAA

SEQ ID NO: 38519 - protein, 9 aa, Artificial Sequence
  Description of Artificial Sequence: Synthetic peptide
  Seed: LSRDILNNF (KKLC1_HUMAN)
LQRDILNNF

SEQ ID NO: 38520 - protein, 10 aa, Artificial Sequence
  Description of Artificial Sequence: Synthetic peptide
  Seed: KYRRFQRNTG (KKLC1_HUMAN)
KIRRFQRNTK

SEQ ID NO: 38521 - protein, 11 aa, Artificial Sequence
  Description of Artificial Sequence: Synthetic peptide
  Seed: RQKRILVNLSM (KKLC1_HUMAN)
RGKRILVNLSV

SEQ ID NO: 38522 - protein, 9 aa, Artificial Sequence
  Description of Artificial Sequence: Synthetic peptide
  Seed: LCALIVFWK (KKLC1_HUMAN)
LTALIVFWK

SEQ ID NO: 38523 - protein, 9 aa, Artificial Sequence
  Description of Artificial Sequence: Synthetic peptide
  Seed: YLLLASSIL (KKLC1_HUMAN)
YTLLASSIV

SEQ ID NO: 38524 - protein, 9 aa, Artificial Sequence
  Description of Artificial Sequence: Synthetic peptide
  Seed: ASSILCALI (KKLC1_HUMAN)
ASSILCALF

SEQ ID NO: 38525 - protein, 11 aa, Artificial Sequence
  Description of Artificial Sequence: Synthetic peptide
  Seed: RQKRILVNLSM (KKLC1_HUMAN)
RTKRILVNLSR

SEQ ID NO: 38526 - protein, 11 aa, Artificial Sequence
  Description of Artificial Sequence: Synthetic peptide
  Seed: LLLASSILCAL (KKLC1_HUMAN)
LALASSILCAV

SEQ ID NO: 38527 - protein, 10 aa, Artificial Sequence
  Description of Artificial Sequence: Synthetic peptide
  Seed: QKRILVNLSM (KKLC1_HUMAN)
QPRILVNLSI

SEQ ID NO: 38528 - protein, 10 aa, Artificial Sequence
  Description of Artificial Sequence: Synthetic peptide
  Seed: GEMSSNSTAL (KKLC1_HUMAN)
GEMSSNSTAV

SEQ ID NO: 38529 - protein, 9 aa, Artificial Sequence
  Description of Artificial Sequence: Synthetic peptide
  Seed: KGFRGASPH (KKLC1_HUMAN)
KEFRGASPY

SEQ ID NO: 38530 - protein, 9 aa, Artificial Sequence
  Description of Artificial Sequence: Synthetic peptide
  Seed: KLVELEHTL (KKLC1_HUMAN)
KNVELEHTY

SEQ ID NO: 38531 - protein, 9 aa, Artificial Sequence
  Description of Artificial Sequence: Synthetic peptide
  Seed: SNTDNNLAV (KKLC1_HUMAN)
SATDNNLAI

SEQ ID NO: 38532 - protein, 9 aa, Artificial Sequence
  Description of Artificial Sequence: Synthetic peptide
  Seed: AVYDLSRDI (KKLC1_HUMAN)
ARYDLSRDI

SEQ ID NO: 38533 - protein, 9 aa, Artificial Sequence
  Description of Artificial Sequence: Synthetic peptide
  Seed: SSNSTALAL (KKLC1_HUMAN)
SQNSTALAW

SEQ ID NO: 38534 - protein, 10 aa, Artificial Sequence
  Description of Artificial Sequence: Synthetic peptide
  Seed: LLLASSILCA (KKLC1_HUMAN)
LWLASSILCV

SEQ ID NO: 38535 - protein, 9 aa, Artificial Sequence
  Description of Artificial Sequence: Synthetic peptide
  Seed: LSRDILNNF (KKLC1_HUMAN)
LKRDILNNY

SEQ ID NO: 38536 - protein, 9 aa, Artificial Sequence
  Description of Artificial Sequence: Synthetic peptide
  Seed: LASSILCAL (KKLC1_HUMAN)
LLSSILCAV

SEQ ID NO: 38537 - protein, 10 aa, Artificial Sequence
  Description of Artificial Sequence: Synthetic peptide
  Seed: MSSNSTALAL (KKLC1_HUMAN)
MDSNSTALAW

SEQ ID NO: 38538 - protein, 10 aa, Artificial Sequence
  Description of Artificial Sequence: Synthetic peptide
  Seed: TLLSKGFRGA (KKLC1_HUMAN)
TLLSKGFRGI

SEQ ID NO: 38539 - protein, 9 aa, Artificial Sequence
  Description of Artificial Sequence: Synthetic peptide
  Seed: KGFRGASPH (KKLC1_HUMAN)
KQFRGASPS

SEQ ID NO: 38540 - protein, 9 aa, Artificial Sequence
  Description of Artificial Sequence: Synthetic peptide
  Seed: KYRRFQRNT (KKLC1_HUMAN)
KARRFQRNV

SEQ ID NO: 38541 - protein, 9 aa, Artificial Sequence
  Description of Artificial Sequence: Synthetic peptide
  Seed: LVRPSSSGL (KKLC1_HUMAN)
LARPSSSGL

SEQ ID NO: 38542 - protein, 10 aa, Artificial Sequence
  Description of Artificial Sequence: Synthetic peptide
  Seed: GEMSSNSTAL (KKLC1_HUMAN)
GSMSSNSTAY

SEQ ID NO: 38543 - protein, 8 aa, Artificial Sequence
  Description of Artificial Sequence: Synthetic peptide
  Seed: VYDLSRDI (KKLC1_HUMAN)
VQDLSRDL

SEQ ID NO: 38544 - protein, 9 aa, Artificial Sequence
  Description of Artificial Sequence: Synthetic peptide
  Seed: LSRDILNNF (KKLC1_HUMAN)
LARDILNNL

SEQ ID NO: 38545 - protein, 9 aa, Artificial Sequence
  Description of Artificial Sequence: Synthetic peptide
  Seed: ASSILCALI (KKLC1_HUMAN)
AVSILCALI

SEQ ID NO: 38546 - protein, 9 aa, Artificial Sequence
  Description of Artificial Sequence: Synthetic peptide
  Seed: NNFPHSIAR (KKLC1_HUMAN)
NFFPHSIAK

SEQ ID NO: 38547 - protein, 11 aa, Artificial Sequence
  Description of Artificial Sequence: Synthetic peptide
  Seed: RQKRILVNLSM (KKLC1_HUMAN)
RVKRILVNLSK

SEQ ID NO: 38548 - protein, 10 aa, Artificial Sequence
  Description of Artificial Sequence: Synthetic peptide
  Seed: DILNNFPHSI (KKLC1_HUMAN)
DMLNNFPHSV

SEQ ID NO: 38549 - protein, 9 aa, Artificial Sequence
  Description of Artificial Sequence: Synthetic peptide
  Seed: LLASSILCA (KKLC1_HUMAN)
LTASSILCV

SEQ ID NO: 38550 - protein, 10 aa, Artificial Sequence
  Description of Artificial Sequence: Synthetic peptide
  Seed: QKRILVNLSM (KKLC1_HUMAN)
QRRILVNLSI

SEQ ID NO: 38551 - protein, 10 aa, Artificial Sequence
  Description of Artificial Sequence: Synthetic peptide
  Seed: LLASSILCAL (KKLC1_HUMAN)
LAASSILCAF

SEQ ID NO: 38552 - protein, 9 aa, Artificial Sequence
  Description of Artificial Sequence: Synthetic peptide
  Seed: NNFPHSIAR (KKLC1_HUMAN)
NLFPHSIAM

SEQ ID NO: 38553 - protein, 9 aa, Artificial Sequence
  Description of Artificial Sequence: Synthetic peptide
  Seed: NTDNNLAVY (KKLC1_HUMAN)
NGDNNLAVV

SEQ ID NO: 38554 - protein, 9 aa, Artificial Sequence
  Description of Artificial Sequence: Synthetic peptide
  Seed: YLLLASSIL (KKLC1_HUMAN)
YPLLASSIA

SEQ ID NO: 38555 - protein, 9 aa, Artificial Sequence
  Description of Artificial Sequence: Synthetic peptide
  Seed: SSNSTALAL (KKLC1_HUMAN)
SPNSTALAF

SEQ ID NO: 38556 - protein, 10 aa, Artificial Sequence
  Description of Artificial Sequence: Synthetic peptide
  Seed: KLVELEHTLL (KKLC1_HUMAN)
KLVELEHTLI

SEQ ID NO: 38557 - protein, 9 aa, Artificial Sequence
  Description of Artificial Sequence: Synthetic peptide
  Seed: SSILCALIV (KKLC1_HUMAN)
STILCALIY

SEQ ID NO: 38558 - protein, 9 aa, Artificial Sequence
  Description of Artificial Sequence: Synthetic peptide
  Seed: SSNSTALAL (KKLC1_HUMAN)
SENSTALAI

SEQ ID NO: 38559 - protein, 10 aa, Artificial Sequence
  Description of Artificial Sequence: Synthetic peptide
  Seed: KLVELEHTLL (KKLC1_HUMAN)
KMVELEHTLL

SEQ ID NO: 38560 - protein, 9 aa, Artificial Sequence
  Description of Artificial Sequence: Synthetic peptide
  Seed: NNFPHSIAR (KKLC1_HUMAN)
NNFPHSIAK

SEQ ID NO: 38561 - protein, 10 aa, Artificial Sequence
  Description of Artificial Sequence: Synthetic peptide
  Seed: NNLAVYDLSR (KKLC1_HUMAN)
NTLAVYDLSR

SEQ ID NO: 38562 - protein, 9 aa, Artificial Sequence
  Description of Artificial Sequence: Synthetic peptide
  Seed: SSNSTALAL (KKLC1_HUMAN)
SRNSTALAI

SEQ ID NO: 38563 - protein, 10 aa, Artificial Sequence
  Description of Artificial Sequence: Synthetic peptide
  Seed: RQKRILVNLS (KKLC1_HUMAN)
RFKRILVNLA

SEQ ID NO: 38564 - protein, 9 aa, Artificial Sequence
  Description of Artificial Sequence: Synthetic peptide
  Seed: SSNSTALAL (KKLC1_HUMAN)
SYNSTALAV

SEQ ID NO: 38565 - protein, 11 aa, Artificial Sequence
  Description of Artificial Sequence: Synthetic peptide
  Seed: YLLLASSILCA (KKLC1_HUMAN)
YFLLASSILCI

SEQ ID NO: 38566 - protein, 10 aa, Artificial Sequence
  Description of Artificial Sequence: Synthetic peptide
  Seed: AVYDLSRDIL (KKLC1_HUMAN)
ALYDLSRDIF

SEQ ID NO: 38567 - protein, 9 aa, Artificial Sequence
  Description of Artificial Sequence: Synthetic peptide
  Seed: NSTALALVR (KKLC1_HUMAN)
NTTALALVK

SEQ ID NO: 38568 - protein, 8 aa, Artificial Sequence
  Description of Artificial Sequence: Synthetic peptide
  Seed: VYDLSRDI (KKLC1_HUMAN)
VVDLSRDF

SEQ ID NO: 38569 - protein, 10 aa, Artificial Sequence
  Description of Artificial Sequence: Synthetic peptide
  Seed: FYLLLASSIL (KKLC1_HUMAN)
FILLLASSIV

SEQ ID NO: 38570 - protein, 10 aa, Artificial Sequence
  Description of Artificial Sequence: Synthetic peptide
  Seed: FYLLLASSIL (KKLC1_HUMAN)
FWLLLASSIV

SEQ ID NO: 38571 - protein, 9 aa, Artificial Sequence
  Description of Artificial Sequence: Synthetic peptide
  Seed: ILNNFPHSI (KKLC1_HUMAN)
ILNNFPHSW

SEQ ID NO: 38572 - protein, 10 aa, Artificial Sequence
  Description of Artificial Sequence: Synthetic peptide
  Seed: LNNFPHSIAR (KKLC1_HUMAN)
LINFPHSIAR

SEQ ID NO: 38573 - protein, 9 aa, Artificial Sequence
  Description of Artificial Sequence: Synthetic peptide
  Seed: ILNNFPHSI (KKLC1_HUMAN)
IINNFPHSM

SEQ ID NO: 38574 - protein, 9 aa, Artificial Sequence
  Description of Artificial Sequence: Synthetic peptide
  Seed: RQKRILVNL (KKLC1_HUMAN)
RSKRILVNE

SEQ ID NO: 38575 - protein, 11 aa, Artificial Sequence
  Description of Artificial Sequence: Synthetic peptide
  Seed: GEMSSNSTALA (KKLC1_HUMAN)
GEMSSNSTALL

SEQ ID NO: 38576 - protein, 9 aa, Artificial Sequence
  Description of Artificial Sequence: Synthetic peptide
  Seed: SSILCALIV (KKLC1_HUMAN)
SSILCALIF

SEQ ID NO: 38577 - protein, 10 aa, Artificial Sequence
  Description of Artificial Sequence: Synthetic peptide
  Seed: FYLLLASSIL (KKLC1_HUMAN)
FYLLLASSIV

SEQ ID NO: 38578 - protein, 10 aa, Artificial Sequence
  Description of Artificial Sequence: Synthetic peptide
  Seed: LASSILCALI (KKLC1_HUMAN)
LTSSILCALI

SEQ ID NO: 38579 - protein, 10 aa, Artificial Sequence
  Description of Artificial Sequence: Synthetic peptide
  Seed: KLVELEHTLL (KKLC1_HUMAN)
KMVELEHTLK

SEQ ID NO: 38580 - protein, 10 aa, Artificial Sequence
  Description of Artificial Sequence: Synthetic peptide
  Seed: RQKRILVNLS (KKLC1_HUMAN)
RTKRILVNLM

SEQ ID NO: 38581 - protein, 9 aa, Artificial Sequence
  Description of Artificial Sequence: Synthetic peptide
  Seed: ILCALIVFW (KKLC1_HUMAN)
IMCALIVFW

SEQ ID NO: 38582 - protein, 11 aa, Artificial Sequence
  Description of Artificial Sequence: Synthetic peptide
  Seed: ILNNFPHSIAR (KKLC1_HUMAN)
ITNNFPHSIAR

SEQ ID NO: 38583 - protein, 10 aa, Artificial Sequence
  Description of Artificial Sequence: Synthetic peptide
  Seed: EMSSNSTALA (KKLC1_HUMAN)
EESSNSTALV

SEQ ID NO: 38584 - protein, 10 aa, Artificial Sequence
  Description of Artificial Sequence: Synthetic peptide
  Seed: LASSILCALI (KKLC1_HUMAN)
LISSILCALW

SEQ ID NO: 38585 - protein, 8 aa, Artificial Sequence
  Description of Artificial Sequence: Synthetic peptide
  Seed: NTDNNLAV (KKLC1_HUMAN)
NVDNNLAM

SEQ ID NO: 38586 - protein, 10 aa, Artificial Sequence
  Description of Artificial Sequence: Synthetic peptide
  Seed: YLLLASSILC (KKLC1_HUMAN)
YDLLASSILM

SEQ ID NO: 38587 - protein, 9 aa, Artificial Sequence
  Description of Artificial Sequence: Synthetic peptide
  Seed: RQKRILVNL (KKLC1_HUMAN)
RIKRILVNA

SEQ ID NO: 38588 - protein, 9 aa, Artificial Sequence
  Description of Artificial Sequence: Synthetic peptide
  Seed: ELEHTLLSK (KKLC1_HUMAN)
EIEHTLLSR

SEQ ID NO: 38589 - protein, 10 aa, Artificial Sequence
  Description of Artificial Sequence: Synthetic peptide
  Seed: FYLLLASSIL (KKLC1_HUMAN)
FVLLLASSIV

SEQ ID NO: 38590 - protein, 10 aa, Artificial Sequence
  Description of Artificial Sequence: Synthetic peptide
  Seed: LASSILCALI (KKLC1_HUMAN)
LMSSILCALD

SEQ ID NO: 38591 - protein, 9 aa, Artificial Sequence
  Description of Artificial Sequence: Synthetic peptide
  Seed: KLVELEHTL (KKLC1_HUMAN)
KVVELEHTF

SEQ ID NO: 38592 - protein, 9 aa, Artificial Sequence
  Description of Artificial Sequence: Synthetic peptide
  Seed: KLVELEHTL (KKLC1_HUMAN)
KDVELEHTM

SEQ ID NO: 38593 - protein, 9 aa, Artificial Sequence
  Description of Artificial Sequence: Synthetic peptide
  Seed: LLASSILCA (KKLC1_HUMAN)
LSASSILCV

SEQ ID NO: 38594 - protein, 9 aa, Artificial Sequence
  Description of Artificial Sequence: Synthetic peptide
  Seed: LASSILCAL (KKLC1_HUMAN)
LMSSILCAY

SEQ ID NO: 38595 - protein, 11 aa, Artificial Sequence
  Description of Artificial Sequence: Synthetic peptide
  Seed: RQKRILVNLSM (KKLC1_HUMAN)
RPKRILVNLSI

SEQ ID NO: 38596 - protein, 10 aa, Artificial Sequence
  Description of Artificial Sequence: Synthetic peptide
  Seed: YLLLASSILC (KKLC1_HUMAN)
YSLLASSILL

SEQ ID NO: 38597 - protein, 10 aa, Artificial Sequence
  Description of Artificial Sequence: Synthetic peptide
  Seed: KLVELEHTLL (KKLC1_HUMAN)
KIVELEHTLW

SEQ ID NO: 38598 - protein, 10 aa, Artificial Sequence
  Description of Artificial Sequence: Synthetic peptide
  Seed: KGFRGASPHR (KKLC1_HUMAN)
KDFRGASPHK

SEQ ID NO: 38599 - protein, 10 aa, Artificial Sequence
  Description of Artificial Sequence: Synthetic peptide
  Seed: KGFRGASPHR (KKLC1_HUMAN)
KTFRGASPHV

SEQ ID NO: 38600 - protein, 8 aa, Artificial Sequence
  Description of Artificial Sequence: Synthetic peptide
  Seed: NTDNNLAV (KKLC1_HUMAN)
NADNNLAI

SEQ ID NO: 38601 - protein, 9 aa, Artificial Sequence
  Description of Artificial Sequence: Synthetic peptide
  Seed: KLVELEHTL (KKLC1_HUMAN)
KVVELEHTK

SEQ ID NO: 38602 - protein, 10 aa, Artificial Sequence
  Description of Artificial Sequence: Synthetic peptide
  Seed: RPSSSGLINS (KKLC1_HUMAN)
RPSSSGLINL

SEQ ID NO: 38603 - protein, 10 aa, Artificial Sequence
  Description of Artificial Sequence: Synthetic peptide
  Seed: SKGFRGASPH (KKLC1_HUMAN)
SRGFRGASPY

SEQ ID NO: 38604 - protein, 9 aa, Artificial Sequence
  Description of Artificial Sequence: Synthetic peptide
  Seed: YLLLASSIL (KKLC1_HUMAN)
YYLLASSIY

SEQ ID NO: 38605 - protein, 9 aa, Artificial Sequence
  Description of Artificial Sequence: Synthetic peptide
  Seed: SNSTALALV (KKLC1_HUMAN)
SISTALALL

SEQ ID NO: 38606 - protein, 10 aa, Artificial Sequence
  Description of Artificial Sequence: Synthetic peptide
  Seed: NKLVELEHTL (KKLC1_HUMAN)
NILVELEHTV

SEQ ID NO: 38607 - protein, 9 aa, Artificial Sequence
  Description of Artificial Sequence: Synthetic peptide
  Seed: ALIVFWKYR (KKLC1_HUMAN)
ASIVFWKYR

SEQ ID NO: 38608 - protein, 9 aa, Artificial Sequence
  Description of Artificial Sequence: Synthetic peptide
  Seed: KLVELEHTL (KKLC1_HUMAN)
KSVELEHTL

SEQ ID NO: 38609 - protein, 10 aa, Artificial Sequence
  Description of Artificial Sequence: Synthetic peptide
  Seed: KGFRGASPHR (KKLC1_HUMAN)
KVFRGASPHK

SEQ ID NO: 38610 - protein, 11 aa, Artificial Sequence
  Description of Artificial Sequence: Synthetic peptide
  Seed: NNFPHSIARQK (KKLC1_HUMAN)
NIFPHSIARQR

SEQ ID NO: 38611 - protein, 9 aa, Artificial Sequence
  Description of Artificial Sequence: Synthetic peptide
  Seed: SSNSTALAL (KKLC1_HUMAN)
SQNSTALAY

SEQ ID NO: 38612 - protein, 10 aa, Artificial Sequence
  Description of Artificial Sequence: Synthetic peptide
  Seed: RQKRILVNLS (KKLC1_HUMAN)
RQKRILVNLK

SEQ ID NO: 38613 - protein, 9 aa, Artificial Sequence
  Description of Artificial Sequence: Synthetic peptide
  Seed: RILVNLSMV (KKLC1_HUMAN)
RMLVNLSMW

SEQ ID NO: 38614 - protein, 11 aa, Artificial Sequence
  Description of Artificial Sequence: Synthetic peptide
  Seed: RQKRILVNLSM (KKLC1_HUMAN)
RVKRILVNLSM

SEQ ID NO: 38615 - protein, 10 aa, Artificial Sequence
  Description of Artificial Sequence: Synthetic peptide
  Seed: SMVENKLVEL (KKLC1_HUMAN)
SQVENKLVEY

SEQ ID NO: 38616 - protein, 9 aa, Artificial Sequence
  Description of Artificial Sequence: Synthetic peptide
  Seed: KYRRFQRNT (KKLC1_HUMAN)
KTRRFQRNA

SEQ ID NO: 38617 - protein, 11 aa, Artificial Sequence
  Description of Artificial Sequence: Synthetic peptide
  Seed: RDILNNFPHSI (KKLC1_HUMAN)
RMILNNFPHSI

SEQ ID NO: 38618 - protein, 9 aa, Artificial Sequence
  Description of Artificial Sequence: Synthetic peptide
  Seed: MSSNSTALA (KKLC1_HUMAN)
MLSNSTALV

SEQ ID NO: 38619 - protein, 9 aa, Artificial Sequence
  Description of Artificial Sequence: Synthetic peptide
  Seed: LASSILCAL (KKLC1_HUMAN)
LISSILCAM

SEQ ID NO: 38620 - protein, 9 aa, Artificial Sequence
  Description of Artificial Sequence: Synthetic peptide
  Seed: NNFPHSIAR (KKLC1_HUMAN)
NAFPHSIAF

SEQ ID NO: 38621 - protein, 10 aa, Artificial Sequence
  Description of Artificial Sequence: Synthetic peptide
  Seed: QKRILVNLSM (KKLC1_HUMAN)
QCRILVNLSI

SEQ ID NO: 38622 - protein, 10 aa, Artificial Sequence
  Description of Artificial Sequence: Synthetic peptide
  Seed: SMVENKLVEL (KKLC1_HUMAN)
STVENKLVEV

SEQ ID NO: 38623 - protein, 9 aa, Artificial Sequence
  Description of Artificial Sequence: Synthetic peptide
  Seed: VYDLSRDIL (KKLC1_HUMAN)
VWDLSRDIV

SEQ ID NO: 38624 - protein, 9 aa, Artificial Sequence
  Description of Artificial Sequence: Synthetic peptide
  Seed: LASSILCAL (KKLC1_HUMAN)
LISSILCAL

SEQ ID NO: 38625 - protein, 9 aa, Artificial Sequence
  Description of Artificial Sequence: Synthetic peptide
  Seed: ALIVFWKYR (KKLC1_HUMAN)
AIIVFWKYK

SEQ ID NO: 38626 - protein, 9 aa, Artificial Sequence
  Description of Artificial Sequence: Synthetic peptide
  Seed: KYRRFQRNT (KKLC1_HUMAN)
KIRRFQRNT

SEQ ID NO: 38627 - protein, 10 aa, Artificial Sequence
  Description of Artificial Sequence: Synthetic peptide
  Seed: LLLASSILCA (KKLC1_HUMAN)
LALASSILCL

SEQ ID NO: 38628 - protein, 11 aa, Artificial Sequence
  Description of Artificial Sequence: Synthetic peptide
  Seed: YLLLASSILCA (KKLC1_HUMAN)
YGLLASSILCL

SEQ ID NO: 38629 - protein, 9 aa, Artificial Sequence
  Description of Artificial Sequence: Synthetic peptide
  Seed: RILVNLSMV (KKLC1_HUMAN)
RMLVNLSML

SEQ ID NO: 38630 - protein, 11 aa, Artificial Sequence
  Description of Artificial Sequence: Synthetic peptide
  Seed: RQKRILVNLSM (KKLC1_HUMAN)
RWKRILVNLSI

SEQ ID NO: 38631 - protein, 9 aa, Artificial Sequence
  Description of Artificial Sequence: Synthetic peptide
  Seed: MVENKLVEL (KKLC1_HUMAN)
MRENKLVEF

SEQ ID NO: 38632 - protein, 11 aa, Artificial Sequence
  Description of Artificial Sequence: Synthetic peptide
  Seed: RQKRILVNLSM (KKLC1_HUMAN)
REKRILVNLSI

SEQ ID NO: 38633 - protein, 9 aa, Artificial Sequence
  Description of Artificial Sequence: Synthetic peptide
  Seed: GFRGASPHR (KKLC1_HUMAN)
GVRGASPHR

SEQ ID NO: 38634 - protein, 8 aa, Artificial Sequence
  Description of Artificial Sequence: Synthetic peptide
  Seed: NTDNNLAV (KKLC1_HUMAN)
NWDNNLAL

SEQ ID NO: 38635 - protein, 9 aa, Artificial Sequence
  Description of Artificial Sequence: Synthetic peptide
  Seed: SSNSTALAL (KKLC1_HUMAN)
SINSTALAW

SEQ ID NO: 38636 - protein, 11 aa, Artificial Sequence
  Description of Artificial Sequence: Synthetic peptide
  Seed: RQKRILVNLSM (KKLC1_HUMAN)
RGKRILVNLSR

SEQ ID NO: 38637 - protein, 10 aa, Artificial Sequence
  Description of Artificial Sequence: Synthetic peptide
  Seed: RRFQRNTGEM (KKLC1_HUMAN)
RYFQRNTGEY

SEQ ID NO: 38638 - protein, 9 aa, Artificial Sequence
  Description of Artificial Sequence: Synthetic peptide
  Seed: KLVELEHTL (KKLC1_HUMAN)
KFVELEHTM

SEQ ID NO: 38639 - protein, 9 aa, Artificial Sequence
  Description of Artificial Sequence: Synthetic peptide
  Seed: ALIVFWKYR (KKLC1_HUMAN)
ASIVFWKYK

SEQ ID NO: 38640 - protein, 10 aa, Artificial Sequence
  Description of Artificial Sequence: Synthetic peptide
  Seed: EMSSNSTALA (KKLC1_HUMAN)
EISSNSTALV

SEQ ID NO: 38641 - protein, 11 aa, Artificial Sequence
  Description of Artificial Sequence: Synthetic peptide
  Seed: MSSNSTALALV (KKLC1_HUMAN)
MTSNSTALALF

SEQ ID NO: 38642 - protein, 9 aa, Artificial Sequence
  Description of Artificial Sequence: Synthetic peptide
  Seed: LVRPSSSGL (KKLC1_HUMAN)
LVRPSSSGK

SEQ ID NO: 38643 - protein, 10 aa, Artificial Sequence
  Description of Artificial Sequence: Synthetic peptide
  Seed: KGFRGASPHR (KKLC1_HUMAN)
KGFRGASPHA

SEQ ID NO: 38644 - protein, 9 aa, Artificial Sequence
  Description of Artificial Sequence: Synthetic peptide
  Seed: KGFRGASPH (KKLC1_HUMAN)
KLFRGASPY

SEQ ID NO: 38645 - protein, 11 aa, Artificial Sequence
  Description of Artificial Sequence: Synthetic peptide
  Seed: RQKRILVNLSM (KKLC1_HUMAN)
RGKRILVNLSI

SEQ ID NO: 38646 - protein, 9 aa, Artificial Sequence
  Description of Artificial Sequence: Synthetic peptide
  Seed: LVRPSSSGL (KKLC1_HUMAN)
LMRPSSSGM

SEQ ID NO: 38647 - protein, 11 aa, Artificial Sequence
  Description of Artificial Sequence: Synthetic peptide
  Seed: LLLASSILCAL (KKLC1_HUMAN)
LYLASSILCAI

SEQ ID NO: 38648 - protein, 8 aa, Artificial Sequence
  Description of Artificial Sequence: Synthetic peptide
  Seed: NTDNNLAV (KKLC1_HUMAN)
NLDNNLAL

SEQ ID NO: 38649 - protein, 10 aa, Artificial Sequence
  Description of Artificial Sequence: Synthetic peptide
  Seed: KGFRGASPHR (KKLC1_HUMAN)
KVFRGASPHI

SEQ ID NO: 38650 - protein, 10 aa, Artificial Sequence
  Description of Artificial Sequence: Synthetic peptide
  Seed: LASSILCALI (KKLC1_HUMAN)
LMSSILCALK

SEQ ID NO: 38651 - protein, 9 aa, Artificial Sequence
  Description of Artificial Sequence: Synthetic peptide
  Seed: CALIVFWKY (KKLC1_HUMAN)
CTLIVFWKW

SEQ ID NO: 38652 - protein, 10 aa, Artificial Sequence
  Description of Artificial Sequence: Synthetic peptide
  Seed: MSSNSTALAL (KKLC1_HUMAN)
MNSNSTALAW

SEQ ID NO: 38653 - protein, 9 aa, Artificial Sequence
  Description of Artificial Sequence: Synthetic peptide
  Seed: ASSILCALI (KKLC1_HUMAN)
ATSILCALF

SEQ ID NO: 38654 - protein, 9 aa, Artificial Sequence
  Description of Artificial Sequence: Synthetic peptide
  Seed: KLVELEHTL (KKLC1_HUMAN)
KIVELEHTF

SEQ ID NO: 38655 - protein, 9 aa, Artificial Sequence
  Description of Artificial Sequence: Synthetic peptide
  Seed: NNFPHSIAR (KKLC1_HUMAN)
NGFPHSIAF

SEQ ID NO: 38656 - protein, 10 aa, Artificial Sequence
  Description of Artificial Sequence: Synthetic peptide
  Seed: FYLLLASSIL (KKLC1_HUMAN)
FYLLLASSIM

SEQ ID NO: 38657 - protein, 10 aa, Artificial Sequence
  Description of Artificial Sequence: Synthetic peptide
  Seed: LLLASSILCA (KKLC1_HUMAN)
LWLASSILCL

SEQ ID NO: 38658 - protein, 9 aa, Artificial Sequence
  Description of Artificial Sequence: Synthetic peptide
  Seed: MSSNSTALA (KKLC1_HUMAN)
MISNSTALI

SEQ ID NO: 38659 - protein, 10 aa, Artificial Sequence
  Description of Artificial Sequence: Synthetic peptide
  Seed: GEMSSNSTAL (KKLC1_HUMAN)
GEMSSNSTAP

SEQ ID NO: 38660 - protein, 9 aa, Artificial Sequence
  Description of Artificial Sequence: Synthetic peptide
  Seed: VYDLSRDIL (KKLC1_HUMAN)
VADLSRDIV

SEQ ID NO: 38661 - protein, 9 aa, Artificial Sequence
  Description of Artificial Sequence: Synthetic peptide
  Seed: ALIVFWKYR (KKLC1_HUMAN)
AGIVFWKYR

SEQ ID NO: 38662 - protein, 9 aa, Artificial Sequence
  Description of Artificial Sequence: Synthetic peptide
  Seed: RQKRILVNL (KKLC1_HUMAN)
RVKRILVNL

SEQ ID NO: 38663 - protein, 11 aa, Artificial Sequence
  Description of Artificial Sequence: Synthetic peptide
  Seed: RRFQRNTGEMS (KKLC1_HUMAN)
RRFQRNTGEMK

SEQ ID NO: 38664 - protein, 9 aa, Artificial Sequence
  Description of Artificial Sequence: Synthetic peptide
  Seed: SSNSTALAL (KKLC1_HUMAN)
SNNSTALAY

SEQ ID NO: 38665 - protein, 11 aa, Artificial Sequence
  Description of Artificial Sequence: Synthetic peptide
  Seed: RQKRILVNLSM (KKLC1_HUMAN)
RFKRILVNLSM

SEQ ID NO: 38666 - protein, 9 aa, Artificial Sequence
  Description of Artificial Sequence: Synthetic peptide
  Seed: KGFRGASPH (KKLC1_HUMAN)
KSFRGASPF

SEQ ID NO: 38667 - protein, 9 aa, Artificial Sequence
  Description of Artificial Sequence: Synthetic peptide
  Seed: KYRRFQRNT (KKLC1_HUMAN)
KVRRFQRNQ

SEQ ID NO: 38668 - protein, 10 aa, Artificial Sequence
  Description of Artificial Sequence: Synthetic peptide
  Seed: TGEMSSNSTA (KKLC1_HUMAN)
TMEMSSNSTA

SEQ ID NO: 38669 - protein, 9 aa, Artificial Sequence
  Description of Artificial Sequence: Synthetic peptide
  Seed: SSILCALIV (KKLC1_HUMAN)
SAILCALIL

SEQ ID NO: 38670 - protein, 9 aa, Artificial Sequence
  Description of Artificial Sequence: Synthetic peptide
  Seed: KGFRGASPH (KKLC1_HUMAN)
KIFRGASPY

SEQ ID NO: 38671 - protein, 9 aa, Artificial Sequence
  Description of Artificial Sequence: Synthetic peptide
  Seed: KGFRGASPH (KKLC1_HUMAN)
KGFRGASPY

SEQ ID NO: 38672 - protein, 9 aa, Artificial Sequence
  Description of Artificial Sequence: Synthetic peptide
  Seed: KRILVNLSM (KKLC1_HUMAN)
KKILVNLSF

SEQ ID NO: 38673 - protein, 9 aa, Artificial Sequence
  Description of Artificial Sequence: Synthetic peptide
  Seed: KGFRGASPH (KKLC1_HUMAN)
KTFRGASPF

SEQ ID NO: 38674 - protein, 10 aa, Artificial Sequence
  Description of Artificial Sequence: Synthetic peptide
  Seed: LASSILCALI (KKLC1_HUMAN)
LASSILCALV

SEQ ID NO: 38675 - protein, 9 aa, Artificial Sequence
  Description of Artificial Sequence: Synthetic peptide
  Seed: RQKRILVNL (KKLC1_HUMAN)
RAKRILVNV

SEQ ID NO: 38676 - protein, 10 aa, Artificial Sequence
  Description of Artificial Sequence: Synthetic peptide
  Seed: SIARQKRILV (KKLC1_HUMAN)
STARQKRILA

SEQ ID NO: 38677 - protein, 9 aa, Artificial Sequence
  Description of Artificial Sequence: Synthetic peptide
  Seed: CALIVFWKY (KKLC1_HUMAN)
CSLIVFWKY

SEQ ID NO: 38678 - protein, 10 aa, Artificial Sequence
  Description of Artificial Sequence: Synthetic peptide
  Seed: TLLSKGFRGA (KKLC1_HUMAN)
TFLSKGFRGV

SEQ ID NO: 38679 - protein, 10 aa, Artificial Sequence
  Description of Artificial Sequence: Synthetic peptide
  Seed: KLVELEHTLL (KKLC1_HUMAN)
KQVELEHTLM

SEQ ID NO: 38680 - protein, 9 aa, Artificial Sequence
  Description of Artificial Sequence: Synthetic peptide
  Seed: VENKLVELE (KKLC1_HUMAN)
VENKLVELP

SEQ ID NO: 38681 - protein, 9 aa, Artificial Sequence
  Description of Artificial Sequence: Synthetic peptide
  Seed: ALIVFWKYR (KKLC1_HUMAN)
AIIVFWKYR

SEQ ID NO: 38682 - protein, 10 aa, Artificial Sequence
  Description of Artificial Sequence: Synthetic peptide
  Seed: LASSILCALI (KKLC1_HUMAN)
LPSSILCALW

SEQ ID NO: 38683 - protein, 9 aa, Artificial Sequence
  Description of Artificial Sequence: Synthetic peptide
  Seed: RRFQRNTGE (KKLC1_HUMAN)
RQFQRNTGL

SEQ ID NO: 38684 - protein, 10 aa, Artificial Sequence
  Description of Artificial Sequence: Synthetic peptide
  Seed: SSILCALIVF (KKLC1_HUMAN)
SQILCALIVY

SEQ ID NO: 38685 - protein, 9 aa, Artificial Sequence
  Description of Artificial Sequence: Synthetic peptide
  Seed: KLVELEHTL (KKLC1_HUMAN)
KAVELEHTH

SEQ ID NO: 38686 - protein, 11 aa, Artificial Sequence
  Description of Artificial Sequence: Synthetic peptide
  Seed: LLLASSILCAL (KKLC1_HUMAN)
LKLASSILCAV

SEQ ID NO: 38687 - protein, 10 aa, Artificial Sequence
  Description of Artificial Sequence: Synthetic peptide
  Seed: MSSNSTALAL (KKLC1_HUMAN)
MESNSTALAF

SEQ ID NO: 38688 - protein, 11 aa, Artificial Sequence
  Description of Artificial Sequence: Synthetic peptide
  Seed: YLLLASSILCA (KKLC1_HUMAN)
YLLLASSILCL

SEQ ID NO: 38689 - protein, 8 aa, Artificial Sequence
  Description of Artificial Sequence: Synthetic peptide
  Seed: RPSSSGLI (KKLC1_HUMAN)
RPSSSGLL

SEQ ID NO: 38690 - protein, 10 aa, Artificial Sequence
  Description of Artificial Sequence: Synthetic peptide
  Seed: KGFRGASPHR (KKLC1_HUMAN)
KCFRGASPHK

SEQ ID NO: 38691 - protein, 9 aa, Artificial Sequence
  Description of Artificial Sequence: Synthetic peptide
  Seed: ILNNFPHSI (KKLC1_HUMAN)
IWNNFPHSW

SEQ ID NO: 38692 - protein, 10 aa, Artificial Sequence
  Description of Artificial Sequence: Synthetic peptide
  Seed: LASSILCALI (KKLC1_HUMAN)
LQSSILCALI

SEQ ID NO: 38693 - protein, 9 aa, Artificial Sequence
  Description of Artificial Sequence: Synthetic peptide
  Seed: MVENKLVEL (KKLC1_HUMAN)
MPENKLVEF

SEQ ID NO: 38694 - protein, 9 aa, Artificial Sequence
  Description of Artificial Sequence: Synthetic peptide
  Seed: NTDNNLAVY (KKLC1_HUMAN)
NFDNNLAVL

SEQ ID NO: 38695 - protein, 9 aa, Artificial Sequence
  Description of Artificial Sequence: Synthetic peptide
  Seed: ILNNFPHSI (KKLC1_HUMAN)
IMNNFPHSF

SEQ ID NO: 38696 - protein, 9 aa, Artificial Sequence
  Description of Artificial Sequence: Synthetic peptide
  Seed: GFRGASPHR (KKLC1_HUMAN)
GMRGASPHR

SEQ ID NO: 38697 - protein, 9 aa, Artificial Sequence
  Description of Artificial Sequence: Synthetic peptide
  Seed: KGFRGASPH (KKLC1_HUMAN)
KGFRGASPF

SEQ ID NO: 38698 - protein, 11 aa, Artificial Sequence
  Description of Artificial Sequence: Synthetic peptide
  Seed: RQKRILVNLSM (KKLC1_HUMAN)
RGKRILVNLSL

SEQ ID NO: 38699 - protein, 9 aa, Artificial Sequence
  Description of Artificial Sequence: Synthetic peptide
  Seed: LVRPSSSGL (KKLC1_HUMAN)
LLRPSSSGV

SEQ ID NO: 38700 - protein, 9 aa, Artificial Sequence
  Description of Artificial Sequence: Synthetic peptide
  Seed: SNSTALALV (KKLC1_HUMAN)
SLSTALALT

SEQ ID NO: 38701 - protein, 10 aa, Artificial Sequence
  Description of Artificial Sequence: Synthetic peptide
  Seed: TLLSKGFRGA (KKLC1_HUMAN)
TMLSKGFRGL

SEQ ID NO: 38702 - protein, 10 aa, Artificial Sequence
  Description of Artificial Sequence: Synthetic peptide
  Seed: QKRILVNLSM (KKLC1_HUMAN)
QDRILVNLSM

SEQ ID NO: 38703 - protein, 9 aa, Artificial Sequence
  Description of Artificial Sequence: Synthetic peptide
  Seed: LLLASSILC (KKLC1_HUMAN)
LILASSILV

SEQ ID NO: 38704 - protein, 10 aa, Artificial Sequence
  Description of Artificial Sequence: Synthetic peptide
  Seed: RRFQRNTGEM (KKLC1_HUMAN)
RRFQRNTGEF

SEQ ID NO: 38705 - protein, 9 aa, Artificial Sequence
  Description of Artificial Sequence: Synthetic peptide
  Seed: NTDNNLAVY (KKLC1_HUMAN)
NTDNNLAVF

SEQ ID NO: 38706 - protein, 9 aa, Artificial Sequence
  Description of Artificial Sequence: Synthetic peptide
  Seed: SSNSTALAL (KKLC1_HUMAN)
SSNSTALAW

SEQ ID NO: 38707 - protein, 9 aa, Artificial Sequence
  Description of Artificial Sequence: Synthetic peptide
  Seed: LLASSILCA (KKLC1_HUMAN)
LVASSILCI

SEQ ID NO: 38708 - protein, 9 aa, Artificial Sequence
  Description of Artificial Sequence: Synthetic peptide
  Seed: SSILCALIV (KKLC1_HUMAN)
STILCALIW

SEQ ID NO: 38709 - protein, 9 aa, Artificial Sequence
  Description of Artificial Sequence: Synthetic peptide
  Seed: NLAVYDLSR (KKLC1_HUMAN)
NVAVYDLSR

SEQ ID NO: 38710 - protein, 9 aa, Artificial Sequence
  Description of Artificial Sequence: Synthetic peptide
  Seed: ILCALIVFW (KKLC1_HUMAN)
ITCALIVFW

SEQ ID NO: 38711 - protein, 9 aa, Artificial Sequence
  Description of Artificial Sequence: Synthetic peptide
  Seed: FWKYRRFQR (KKLC1_HUMAN)
FLKYRRFQR

SEQ ID NO: 38712 - protein, 10 aa, Artificial Sequence
  Description of Artificial Sequence: Synthetic peptide
  Seed: ALVRPSSSGL (KKLC1_HUMAN)
ATVRPSSSGA

SEQ ID NO: 38713 - protein, 8 aa, Artificial Sequence
  Description of Artificial Sequence: Synthetic peptide
  Seed: VYDLSRDI (KKLC1_HUMAN)
VADLSRDM

SEQ ID NO: 38714 - protein, 9 aa, Artificial Sequence
  Description of Artificial Sequence: Synthetic peptide
  Seed: KLVELEHTL (KKLC1_HUMAN)
KIVELEHTK

SEQ ID NO: 38715 - protein, 9 aa, Artificial Sequence
  Description of Artificial Sequence: Synthetic peptide
  Seed: IVFWKYRRF (KKLC1_HUMAN)
ISFWKYRRF

SEQ ID NO: 38716 - protein, 10 aa, Artificial Sequence
  Description of Artificial Sequence: Synthetic peptide
  Seed: ALIVFWKYRR (KKLC1_HUMAN)
AMIVFWKYRK

SEQ ID NO: 38717 - protein, 11 aa, Artificial Sequence
  Description of Artificial Sequence: Synthetic peptide
  Seed: YLLLASSILCA (KKLC1_HUMAN)
YELLASSILCV

SEQ ID NO: 38718 - protein, 10 aa, Artificial Sequence
  Description of Artificial Sequence: Synthetic peptide
  Seed: LLLASSILCA (KKLC1_HUMAN)
LKLASSILCV

SEQ ID NO: 38719 - protein, 11 aa, Artificial Sequence
  Description of Artificial Sequence: Synthetic peptide
  Seed: MNFYLLLASSI (KKLC1_HUMAN)
MHFYLLLASSF

SEQ ID NO: 38720 - protein, 9 aa, Artificial Sequence
  Description of Artificial Sequence: Synthetic peptide
  Seed: RQKRILVNL (KKLC1_HUMAN)
RIKRILVNV

SEQ ID NO: 38721 - protein, 10 aa, Artificial Sequence
  Description of Artificial Sequence: Synthetic peptide
  Seed: LLASSILCAL (KKLC1_HUMAN)
LIASSILCAM

SEQ ID NO: 38722 - protein, 9 aa, Artificial Sequence
  Description of Artificial Sequence: Synthetic peptide
  Seed: LSMVENKLV (KKLC1_HUMAN)
LSMVENKLY

SEQ ID NO: 38723 - protein, 9 aa, Artificial Sequence
  Description of Artificial Sequence: Synthetic peptide
  Seed: VNLSMVENK (KKLC1_HUMAN)
VLLSMVENR

SEQ ID NO: 38724 - protein, 10 aa, Artificial Sequence
  Description of Artificial Sequence: Synthetic peptide
  Seed: LLASSILCAL (KKLC1_HUMAN)
LMASSILCAY

SEQ ID NO: 38725 - protein, 9 aa, Artificial Sequence
  Description of Artificial Sequence: Synthetic peptide
  Seed: ILCALIVFW (KKLC1_HUMAN)
ITCALIVFL

SEQ ID NO: 38726 - protein, 9 aa, Artificial Sequence
  Description of Artificial Sequence: Synthetic peptide
  Seed: ALIVFWKYR (KKLC1_HUMAN)
AAIVFWKYR

SEQ ID NO: 38727 - protein, 10 aa, Artificial Sequence
  Description of Artificial Sequence: Synthetic peptide
  Seed: LLASSILCAL (KKLC1_HUMAN)
LVASSILCAF

SEQ ID NO: 38728 - protein, 10 aa, Artificial Sequence
  Description of Artificial Sequence: Synthetic peptide
  Seed: NFYLLLASSI (KKLC1_HUMAN)
NFYLLLASSF

SEQ ID NO: 38729 - protein, 9 aa, Artificial Sequence
  Description of Artificial Sequence: Synthetic peptide
  Seed: KRILVNLSM (KKLC1_HUMAN)
KHILVNLSM

SEQ ID NO: 38730 - protein, 9 aa, Artificial Sequence
  Description of Artificial Sequence: Synthetic peptide
  Seed: ILNNFPHSI (KKLC1_HUMAN)
IMNNFPHSR

SEQ ID NO: 38731 - protein, 10 aa, Artificial Sequence
  Description of Artificial Sequence: Synthetic peptide
  Seed: RQKRILVNLS (KKLC1_HUMAN)
RTKRILVNLL

SEQ ID NO: 38732 - protein, 9 aa, Artificial Sequence
  Description of Artificial Sequence: Synthetic peptide
  Seed: YLLLASSIL (KKLC1_HUMAN)
YMLLASSIW

SEQ ID NO: 38733 - protein, 8 aa, Artificial Sequence
  Description of Artificial Sequence: Synthetic peptide
  Seed: VYDLSRDI (KKLC1_HUMAN)
VVDLSRDL

SEQ ID NO: 38734 - protein, 10 aa, Artificial Sequence
  Description of Artificial Sequence: Synthetic peptide
  Seed: GEMSSNSTAL (KKLC1_HUMAN)
GLMSSNSTAF

SEQ ID NO: 38735 - protein, 10 aa, Artificial Sequence
  Description of Artificial Sequence: Synthetic peptide
  Seed: MSSNSTALAL (KKLC1_HUMAN)
MSSNSTALAV

SEQ ID NO: 38736 - protein, 10 aa, Artificial Sequence
  Description of Artificial Sequence: Synthetic peptide
  Seed: SMVENKLVEL (KKLC1_HUMAN)
SYVENKLVEL

SEQ ID NO: 38737 - protein, 9 aa, Artificial Sequence
  Description of Artificial Sequence: Synthetic peptide
  Seed: LVRPSSSGL (KKLC1_HUMAN)
LMRPSSSGW

SEQ ID NO: 38738 - protein, 9 aa, Artificial Sequence
  Description of Artificial Sequence: Synthetic peptide
  Seed: RQKRILVNL (KKLC1_HUMAN)
RYKRILVNL

SEQ ID NO: 38739 - protein, 9 aa, Artificial Sequence
  Description of Artificial Sequence: Synthetic peptide
  Seed: LLASSILCA (KKLC1_HUMAN)
LLASSILCV

SEQ ID NO: 38740 - protein, 11 aa, Artificial Sequence
  Description of Artificial Sequence: Synthetic peptide
  Seed: GLINSNTDNNL (KKLC1_HUMAN)
GQINSNTDNNW

SEQ ID NO: 38741 - protein, 9 aa, Artificial Sequence
  Description of Artificial Sequence: Synthetic peptide
  Seed: SSILCALIV (KKLC1_HUMAN)
SQILCALIV

SEQ ID NO: 38742 - protein, 10 aa, Artificial Sequence
  Description of Artificial Sequence: Synthetic peptide
  Seed: MSSNSTALAL (KKLC1_HUMAN)
MQSNSTALAY

SEQ ID NO: 38743 - protein, 9 aa, Artificial Sequence
  Description of Artificial Sequence: Synthetic peptide
  Seed: RQKRILVNL (KKLC1_HUMAN)
RLKRILVNA

SEQ ID NO: 38744 - protein, 9 aa, Artificial Sequence
  Description of Artificial Sequence: Synthetic peptide
  Seed: SSNSTALAL (KKLC1_HUMAN)
STNSTALAI

SEQ ID NO: 38745 - protein, 9 aa, Artificial Sequence
  Description of Artificial Sequence: Synthetic peptide
  Seed: MVENKLVEL (KKLC1_HUMAN)
MSENKLVEI

SEQ ID NO: 38746 - protein, 10 aa, Artificial Sequence
  Description of Artificial Sequence: Synthetic peptide
  Seed: LASSILCALI (KKLC1_HUMAN)
LMSSILCALW

SEQ ID NO: 38747 - protein, 9 aa, Artificial Sequence
  Description of Artificial Sequence: Synthetic peptide
  Seed: MVENKLVEL (KKLC1_HUMAN)
MSENKLVEL

SEQ ID NO: 38748 - protein, 9 aa, Artificial Sequence
  Description of Artificial Sequence: Synthetic peptide
  Seed: LASSILCAL (KKLC1_HUMAN)
LGSSILCAW

SEQ ID NO: 38749 - protein, 9 aa, Artificial Sequence
  Description of Artificial Sequence: Synthetic peptide
  Seed: LASSILCAL (KKLC1_HUMAN)
LASSILCAW

SEQ ID NO: 38750 - protein, 10 aa, Artificial Sequence
  Description of Artificial Sequence: Synthetic peptide
  Seed: GEMSSNSTAL (KKLC1_HUMAN)
GHMSSNSTAF

SEQ ID NO: 38751 - protein, 10 aa, Artificial Sequence
  Description of Artificial Sequence: Synthetic peptide
  Seed: TGEMSSNSTA (KKLC1_HUMAN)
TKEMSSNSTA

SEQ ID NO: 38752 - protein, 10 aa, Artificial Sequence
  Description of Artificial Sequence: Synthetic peptide
  Seed: ALVRPSSSGL (KKLC1_HUMAN)
ASVRPSSSGK

SEQ ID NO: 38753 - protein, 9 aa, Artificial Sequence
  Description of Artificial Sequence: Synthetic peptide
  Seed: IVFWKYRRF (KKLC1_HUMAN)
ITFWKYRRY

SEQ ID NO: 38754 - protein, 9 aa, Artificial Sequence
  Description of Artificial Sequence: Synthetic peptide
  Seed: LLASSILCA (KKLC1_HUMAN)
LIASSILCV

SEQ ID NO: 38755 - protein, 10 aa, Artificial Sequence
  Description of Artificial Sequence: Synthetic peptide
  Seed: LLLASSILCA (KKLC1_HUMAN)
LTLASSILCV

SEQ ID NO: 38756 - protein, 10 aa, Artificial Sequence
  Description of Artificial Sequence: Synthetic peptide
  Seed: MSSNSTALAL (KKLC1_HUMAN)
MRSNSTALAF

SEQ ID NO: 38757 - protein, 10 aa, Artificial Sequence
  Description of Artificial Sequence: Synthetic peptide
  Seed: KLVELEHTLL (KKLC1_HUMAN)
KVVELEHTLV

SEQ ID NO: 38758 - protein, 9 aa, Artificial Sequence
  Description of Artificial Sequence: Synthetic peptide
  Seed: NTDNNLAVY (KKLC1_HUMAN)
NADNNLAVI

SEQ ID NO: 38759 - protein, 9 aa, Artificial Sequence
  Description of Artificial Sequence: Synthetic peptide
  Seed: NSTALALVR (KKLC1_HUMAN)
NVTALALVK

SEQ ID NO: 38760 - protein, 9 aa, Artificial Sequence
  Description of Artificial Sequence: Synthetic peptide
  Seed: SNTDNNLAV (KKLC1_HUMAN)
STTDNNLAI

SEQ ID NO: 38761 - protein, 9 aa, Artificial Sequence
  Description of Artificial Sequence: Synthetic peptide
  Seed: KGFRGASPH (KKLC1_HUMAN)
KEFRGASPM

SEQ ID NO: 38762 - protein, 9 aa, Artificial Sequence
  Description of Artificial Sequence: Synthetic peptide
  Seed: YLLLASSIL (KKLC1_HUMAN)
YYLLASSIF

SEQ ID NO: 38763 - protein, 9 aa, Artificial Sequence
  Description of Artificial Sequence: Synthetic peptide
  Seed: NTDNNLAVY (KKLC1_HUMAN)
NYDNNLAVM

SEQ ID NO: 38764 - protein, 9 aa, Artificial Sequence
  Description of Artificial Sequence: Synthetic peptide
  Seed: NNFPHSIAR (KKLC1_HUMAN)
NSFPHSIAY

SEQ ID NO: 38765 - protein, 10 aa, Artificial Sequence
  Description of Artificial Sequence: Synthetic peptide
  Seed: AVYDLSRDIL (KKLC1_HUMAN)
AMYDLSRDIL

SEQ ID NO: 38766 - protein, 9 aa, Artificial Sequence
  Description of Artificial Sequence: Synthetic peptide
  Seed: SILCALIVF (KKLC1_HUMAN)
SKLCALIVY

SEQ ID NO: 38767 - protein, 10 aa, Artificial Sequence
  Description of Artificial Sequence: Synthetic peptide
  Seed: KGFRGASPHR (KKLC1_HUMAN)
KSFRGASPHR

SEQ ID NO: 38768 - protein, 9 aa, Artificial Sequence
  Description of Artificial Sequence: Synthetic peptide
  Seed: YLLLASSIL (KKLC1_HUMAN)
YTLLASSIL

SEQ ID NO: 38769 - protein, 9 aa, Artificial Sequence
  Description of Artificial Sequence: Synthetic peptide
  Seed: SNTDNNLAV (KKLC1_HUMAN)
SQTDNNLAV

SEQ ID NO: 38770 - protein, 9 aa, Artificial Sequence
  Description of Artificial Sequence: Synthetic peptide
  Seed: FYLLLASSI (KKLC1_HUMAN)
FWLLLASSW

SEQ ID NO: 38771 - protein, 10 aa, Artificial Sequence
  Description of Artificial Sequence: Synthetic peptide
  Seed: FYLLLASSIL (KKLC1_HUMAN)
FMLLLASSIL

SEQ ID NO: 38772 - protein, 9 aa, Artificial Sequence
  Description of Artificial Sequence: Synthetic peptide
  Seed: LVRPSSSGL (KKLC1_HUMAN)
LTRPSSSGV

SEQ ID NO: 38773 - protein, 9 aa, Artificial Sequence
  Description of Artificial Sequence: Synthetic peptide
  Seed: EMSSNSTAL (KKLC1_HUMAN)
EMSSNSTAY

SEQ ID NO: 38774 - protein, 10 aa, Artificial Sequence
  Description of Artificial Sequence: Synthetic peptide
  Seed: KGFRGASPHR (KKLC1_HUMAN)
KAFRGASPHV

SEQ ID NO: 38775 - protein, 9 aa, Artificial Sequence
  Description of Artificial Sequence: Synthetic peptide
  Seed: ELEHTLLSK (KKLC1_HUMAN)
EVEHTLLSR

SEQ ID NO: 38776 - protein, 9 aa, Artificial Sequence
  Description of Artificial Sequence: Synthetic peptide
  Seed: KLVELEHTL (KKLC1_HUMAN)
KKVELEHTY

SEQ ID NO: 38777 - protein, 10 aa, Artificial Sequence
  Description of Artificial Sequence: Synthetic peptide
  Seed: LLASSILCAL (KKLC1_HUMAN)
LSASSILCAV

SEQ ID NO: 38778 - protein, 9 aa, Artificial Sequence
  Description of Artificial Sequence: Synthetic peptide
  Seed: YLLLASSIL (KKLC1_HUMAN)
YVLLASSIV

SEQ ID NO: 38779 - protein, 8 aa, Artificial Sequence
  Description of Artificial Sequence: Synthetic peptide
  Seed: NTDNNLAV (KKLC1_HUMAN)
NFDNNLAF

SEQ ID NO: 38780 - protein, 9 aa, Artificial Sequence
  Description of Artificial Sequence: Synthetic peptide
  Seed: IARQKRILV (KKLC1_HUMAN)
IARQKRILY

SEQ ID NO: 38781 - protein, 9 aa, Artificial Sequence
  Description of Artificial Sequence: Synthetic peptide
  Seed: ILNNFPHSI (KKLC1_HUMAN)
IMNNFPHSI

SEQ ID NO: 38782 - protein, 11 aa, Artificial Sequence
  Description of Artificial Sequence: Synthetic peptide
  Seed: LLASSILCALI (KKLC1_HUMAN)
LLASSILCALL

SEQ ID NO: 38783 - protein, 9 aa, Artificial Sequence
  Description of Artificial Sequence: Synthetic peptide
  Seed: LASSILCAL (KKLC1_HUMAN)
LQSSILCAH

SEQ ID NO: 38784 - protein, 9 aa, Artificial Sequence
  Description of Artificial Sequence: Synthetic peptide
  Seed: LVRPSSSGL (KKLC1_HUMAN)
LSRPSSSGM

SEQ ID NO: 38785 - protein, 9 aa, Artificial Sequence
  Description of Artificial Sequence: Synthetic peptide
  Seed: IARQKRILV (KKLC1_HUMAN)
IVRQKRILA

SEQ ID NO: 38786 - protein, 9 aa, Artificial Sequence
  Description of Artificial Sequence: Synthetic peptide
  Seed: MSSNSTALA (KKLC1_HUMAN)
MSSNSTALI

SEQ ID NO: 38787 - protein, 9 aa, Artificial Sequence
  Description of Artificial Sequence: Synthetic peptide
  Seed: YLLLASSIL (KKLC1_HUMAN)
YQLLASSIV

SEQ ID NO: 38788 - protein, 10 aa, Artificial Sequence
  Description of Artificial Sequence: Synthetic peptide
  Seed: KYRRFQRNTG (KKLC1_HUMAN)
KMRRFQRNTV

SEQ ID NO: 38789 - protein, 9 aa, Artificial Sequence
  Description of Artificial Sequence: Synthetic peptide
  Seed: GEMSSNSTA (KKLC1_HUMAN)
GEMSSNSTT

SEQ ID NO: 38790 - protein, 8 aa, Artificial Sequence
  Description of Artificial Sequence: Synthetic peptide
  Seed: MSSNSTAL (KKLC1_HUMAN)
MASNSTAY

SEQ ID NO: 38791 - protein, 10 aa, Artificial Sequence
  Description of Artificial Sequence: Synthetic peptide
  Seed: VFWKYRRFQR (KKLC1_HUMAN)
VVWKYRRFQK

SEQ ID NO: 38792 - protein, 9 aa, Artificial Sequence
  Description of Artificial Sequence: Synthetic peptide
  Seed: YLLLASSIL (KKLC1_HUMAN)
YLLLASSIM

SEQ ID NO: 38793 - protein, 9 aa, Artificial Sequence
  Description of Artificial Sequence: Synthetic peptide
  Seed: KLVELEHTL (KKLC1_HUMAN)
KVVELEHTR

SEQ ID NO: 38794 - protein, 10 aa, Artificial Sequence
  Description of Artificial Sequence: Synthetic peptide
  Seed: SNSTALALVR (KKLC1_HUMAN)
SYSTALALVR

SEQ ID NO: 38795 - protein, 9 aa, Artificial Sequence
  Description of Artificial Sequence: Synthetic peptide
  Seed: SSNSTALAL (KKLC1_HUMAN)
SINSTALAF

SEQ ID NO: 38796 - protein, 10 aa, Artificial Sequence
  Description of Artificial Sequence: Synthetic peptide
  Seed: RQKRILVNLS (KKLC1_HUMAN)
RTKRILVNLI

SEQ ID NO: 38797 - protein, 9 aa, Artificial Sequence
  Description of Artificial Sequence: Synthetic peptide
  Seed: KLVELEHTL (KKLC1_HUMAN)
KLVELEHTK

SEQ ID NO: 38798 - protein, 10 aa, Artificial Sequence
  Description of Artificial Sequence: Synthetic peptide
  Seed: SNSTALALVR (KKLC1_HUMAN)
SFSTALALVR

SEQ ID NO: 38799 - protein, 9 aa, Artificial Sequence
  Description of Artificial Sequence: Synthetic peptide
  Seed: LSRDILNNF (KKLC1_HUMAN)
LYRDILNNF

SEQ ID NO: 38800 - protein, 9 aa, Artificial Sequence
  Description of Artificial Sequence: Synthetic peptide
  Seed: SNTDNNLAV (KKLC1_HUMAN)
SQTDNNLAI

SEQ ID NO: 38801 - protein, 10 aa, Artificial Sequence
  Description of Artificial Sequence: Synthetic peptide
  Seed: YLLLASSILC (KKLC1_HUMAN)
YNLLASSILL

SEQ ID NO: 38802 - protein, 11 aa, Artificial Sequence
  Description of Artificial Sequence: Synthetic peptide
  Seed: MSSNSTALALV (KKLC1_HUMAN)
MTSNSTALALV

SEQ ID NO: 38803 - protein, 9 aa, Artificial Sequence
  Description of Artificial Sequence: Synthetic peptide
  Seed: LVRPSSSGL (KKLC1_HUMAN)
LSRPSSSGL

SEQ ID NO: 38804 - protein, 10 aa, Artificial Sequence
  Description of Artificial Sequence: Synthetic peptide
  Seed: QKRILVNLSM (KKLC1_HUMAN)
QGRILVNLSV

SEQ ID NO: 38805 - protein, 11 aa, Artificial Sequence
  Description of Artificial Sequence: Synthetic peptide
  Seed: RQKRILVNLSM (KKLC1_HUMAN)
RLKRILVNLSI

SEQ ID NO: 38806 - protein, 9 aa, Artificial Sequence
  Description of Artificial Sequence: Synthetic peptide
  Seed: NLSMVENKL (KKLC1_HUMAN)
NMSMVENKV

SEQ ID NO: 38807 - protein, 10 aa, Artificial Sequence
  Description of Artificial Sequence: Synthetic peptide
  Seed: KGFRGASPHR (KKLC1_HUMAN)
KIFRGASPHK

SEQ ID NO: 38808 - protein, 9 aa, Artificial Sequence
  Description of Artificial Sequence: Synthetic peptide
  Seed: NNFPHSIAR (KKLC1_HUMAN)
NMFPHSIAL

SEQ ID NO: 38809 - protein, 9 aa, Artificial Sequence
  Description of Artificial Sequence: Synthetic peptide
  Seed: NNFPHSIAR (KKLC1_HUMAN)
NIFPHSIAV

SEQ ID NO: 38810 - protein, 10 aa, Artificial Sequence
  Description of Artificial Sequence: Synthetic peptide
  Seed: SMVENKLVEL (KKLC1_HUMAN)
SLVENKLVEV

SEQ ID NO: 38811 - protein, 9 aa, Artificial Sequence
  Description of Artificial Sequence: Synthetic peptide
  Seed: ILNNFPHSI (KKLC1_HUMAN)
IQNNFPHSY

SEQ ID NO: 38812 - protein, 9 aa, Artificial Sequence
  Description of Artificial Sequence: Synthetic peptide
  Seed: LSMVENKLV (KKLC1_HUMAN)
LTMVENKLY

SEQ ID NO: 38813 - protein, 9 aa, Artificial Sequence
  Description of Artificial Sequence: Synthetic peptide
  Seed: NNFPHSIAR (KKLC1_HUMAN)
NYFPHSIAR

SEQ ID NO: 38814 - protein, 9 aa, Artificial Sequence
  Description of Artificial Sequence: Synthetic peptide
  Seed: SSNSTALAL (KKLC1_HUMAN)
SVNSTALAL

SEQ ID NO: 38815 - protein, 9 aa, Artificial Sequence
  Description of Artificial Sequence: Synthetic peptide
  Seed: LSRDILNNF (KKLC1_HUMAN)
LARDILNNF

SEQ ID NO: 38816 - protein, 9 aa, Artificial Sequence
  Description of Artificial Sequence: Synthetic peptide
  Seed: RQKRILVNL (KKLC1_HUMAN)
RFKRILVNA

SEQ ID NO: 38817 - protein, 9 aa, Artificial Sequence
  Description of Artificial Sequence: Synthetic peptide
  Seed: SSNSTALAL (KKLC1_HUMAN)
STNSTALAY

SEQ ID NO: 38818 - protein, 11 aa, Artificial Sequence
  Description of Artificial Sequence: Synthetic peptide
  Seed: YLLLASSILCA (KKLC1_HUMAN)
YPLLASSILCV

SEQ ID NO: 38819 - protein, 9 aa, Artificial Sequence
  Description of Artificial Sequence: Synthetic peptide
  Seed: KRILVNLSM (KKLC1_HUMAN)
KFILVNLSM

SEQ ID NO: 38820 - protein, 9 aa, Artificial Sequence
  Description of Artificial Sequence: Synthetic peptide
  Seed: LLSKGFRGA (KKLC1_HUMAN)
LLSKGFRGI

SEQ ID NO: 38821 - protein, 9 aa, Artificial Sequence
  Description of Artificial Sequence: Synthetic peptide
  Seed: SSNSTALAL (KKLC1_HUMAN)
SPNSTALAL

SEQ ID NO: 38822 - protein, 11 aa, Artificial Sequence
  Description of Artificial Sequence: Synthetic peptide
  Seed: RQKRILVNLSM (KKLC1_HUMAN)
RMKRILVNLSI

SEQ ID NO: 38823 - protein, 10 aa, Artificial Sequence
  Description of Artificial Sequence: Synthetic peptide
  Seed: SNTDNNLAVY (KKLC1_HUMAN)
SSTDNNLAVY

SEQ ID NO: 38824 - protein, 9 aa, Artificial Sequence
  Description of Artificial Sequence: Synthetic peptide
  Seed: LSRDILNNF (KKLC1_HUMAN)
LIRDILNNW

SEQ ID NO: 38825 - protein, 10 aa, Artificial Sequence
  Description of Artificial Sequence: Synthetic peptide
  Seed: LLASSILCAL (KKLC1_HUMAN)
LSASSILCAF

SEQ ID NO: 38826 - protein, 8 aa, Artificial Sequence
  Description of Artificial Sequence: Synthetic peptide
  Seed: VENKLVEL (KKLC1_HUMAN)
VENKLVEM

SEQ ID NO: 38827 - protein, 10 aa, Artificial Sequence
  Description of Artificial Sequence: Synthetic peptide
  Seed: SKGFRGASPH (KKLC1_HUMAN)
SEGFRGASPY

SEQ ID NO: 38828 - protein, 10 aa, Artificial Sequence
  Description of Artificial Sequence: Synthetic peptide
  Seed: SMVENKLVEL (KKLC1_HUMAN)
SYVENKLVEM

SEQ ID NO: 38829 - protein, 10 aa, Artificial Sequence
  Description of Artificial Sequence: Synthetic peptide
  Seed: EHTLLSKGFR (KKLC1_HUMAN)
ELTLLSKGFR

SEQ ID NO: 38830 - protein, 10 aa, Artificial Sequence
  Description of Artificial Sequence: Synthetic peptide
  Seed: SSNSTALALV (KKLC1_HUMAN)
SMNSTALALL

SEQ ID NO: 38831 - protein, 10 aa, Artificial Sequence
  Description of Artificial Sequence: Synthetic peptide
  Seed: LLASSILCAL (KKLC1_HUMAN)
LMASSILCAL

SEQ ID NO: 38832 - protein, 9 aa, Artificial Sequence
  Description of Artificial Sequence: Synthetic peptide
  Seed: MVENKLVEL (KKLC1_HUMAN)
MMENKLVEL

SEQ ID NO: 38833 - protein, 10 aa, Artificial Sequence
  Description of Artificial Sequence: Synthetic peptide
  Seed: LNNFPHSIAR (KKLC1_HUMAN)
LYNFPHSIAR

SEQ ID NO: 38834 - protein, 9 aa, Artificial Sequence
  Description of Artificial Sequence: Synthetic peptide
  Seed: RQKRILVNL (KKLC1_HUMAN)
RSKRILVNK

SEQ ID NO: 38835 - protein, 9 aa, Artificial Sequence
  Description of Artificial Sequence: Synthetic peptide
  Seed: LVELEHTLL (KKLC1_HUMAN)
LTELEHTLL

SEQ ID NO: 38836 - protein, 9 aa, Artificial Sequence
  Description of Artificial Sequence: Synthetic peptide
  Seed: KGFRGASPH (KKLC1_HUMAN)
KVFRGASPL

SEQ ID NO: 38837 - protein, 11 aa, Artificial Sequence
  Description of Artificial Sequence: Synthetic peptide
  Seed: YRRFQRNTGEM (KKLC1_HUMAN)
YYRFQRNTGEF

SEQ ID NO: 38838 - protein, 9 aa, Artificial Sequence
  Description of Artificial Sequence: Synthetic peptide
  Seed: KYRRFQRNT (KKLC1_HUMAN)
KTRRFQRNN

SEQ ID NO: 38839 - protein, 9 aa, Artificial Sequence
  Description of Artificial Sequence: Synthetic peptide
  Seed: ASSILCALI (KKLC1_HUMAN)
AVSILCALW

SEQ ID NO: 38840 - protein, 10 aa, Artificial Sequence
  Description of Artificial Sequence: Synthetic peptide
  Seed: GEMSSNSTAL (KKLC1_HUMAN)
GNMSSNSTAF

SEQ ID NO: 38841 - protein, 9 aa, Artificial Sequence
  Description of Artificial Sequence: Synthetic peptide
  Seed: IVFWKYRRF (KKLC1_HUMAN)
ITFWKYRRW

SEQ ID NO: 38842 - protein, 10 aa, Artificial Sequence
  Description of Artificial Sequence: Synthetic peptide
  Seed: MSSNSTALAL (KKLC1_HUMAN)
MPSNSTALAF

SEQ ID NO: 38843 - protein, 10 aa, Artificial Sequence
  Description of Artificial Sequence: Synthetic peptide
  Seed: MSSNSTALAL (KKLC1_HUMAN)
MISNSTALAY

SEQ ID NO: 38844 - protein, 9 aa, Artificial Sequence
  Description of Artificial Sequence: Synthetic peptide
  Seed: VENKLVELE (KKLC1_HUMAN)
VENKLVELA

SEQ ID NO: 38845 - protein, 9 aa, Artificial Sequence
  Description of Artificial Sequence: Synthetic peptide
  Seed: NTDNNLAVY (KKLC1_HUMAN)
NIDNNLAVM

SEQ ID NO: 38846 - protein, 9 aa, Artificial Sequence
  Description of Artificial Sequence: Synthetic peptide
  Seed: KYRRFQRNT (KKLC1_HUMAN)
KWRRFQRNM

SEQ ID NO: 38847 - protein, 9 aa, Artificial Sequence
  Description of Artificial Sequence: Synthetic peptide
  Seed: SILCALIVF (KKLC1_HUMAN)
SILCALIVY

SEQ ID NO: 38848 - protein, 10 aa, Artificial Sequence
  Description of Artificial Sequence: Synthetic peptide
  Seed: LNNFPHSIAR (KKLC1_HUMAN)
LVNFPHSIAK

SEQ ID NO: 38849 - protein, 9 aa, Artificial Sequence
  Description of Artificial Sequence: Synthetic peptide
  Seed: YLLLASSIL (KKLC1_HUMAN)
YWLLASSIF

SEQ ID NO: 38850 - protein, 9 aa, Artificial Sequence
  Description of Artificial Sequence: Synthetic peptide
  Seed: LVRPSSSGL (KKLC1_HUMAN)
LVRPSSSGM

SEQ ID NO: 38851 - protein, 11 aa, Artificial Sequence
  Description of Artificial Sequence: Synthetic peptide
  Seed: MSSNSTALALV (KKLC1_HUMAN)
MSSNSTALALW

SEQ ID NO: 38852 - protein, 9 aa, Artificial Sequence
  Description of Artificial Sequence: Synthetic peptide
  Seed: YLLLASSIL (KKLC1_HUMAN)
YLLLASSIF

SEQ ID NO: 38853 - protein, 9 aa, Artificial Sequence
  Description of Artificial Sequence: Synthetic peptide
  Seed: NNFPHSIAR (KKLC1_HUMAN)
NQFPHSIAY

SEQ ID NO: 38854 - protein, 9 aa, Artificial Sequence
  Description of Artificial Sequence: Synthetic peptide
  Seed: ILNNFPHSI (KKLC1_HUMAN)
ITNNFPHSM

SEQ ID NO: 38855 - protein, 9 aa, Artificial Sequence
  Description of Artificial Sequence: Synthetic peptide
  Seed: LLLASSILC (KKLC1_HUMAN)
LQLASSILV

SEQ ID NO: 38856 - protein, 10 aa, Artificial Sequence
  Description of Artificial Sequence: Synthetic peptide
  Seed: SSILCALIVF (KKLC1_HUMAN)
SMILCALIVY

SEQ ID NO: 38857 - protein, 9 aa, Artificial Sequence
  Description of Artificial Sequence: Synthetic peptide
  Seed: KGFRGASPH (KKLC1_HUMAN)
KSFRGASPL

SEQ ID NO: 38858 - protein, 10 aa, Artificial Sequence
  Description of Artificial Sequence: Synthetic peptide
  Seed: EHTLLSKGFR (KKLC1_HUMAN)
ECTLLSKGFR

SEQ ID NO: 38859 - protein, 9 aa, Artificial Sequence
  Description of Artificial Sequence: Synthetic peptide
  Seed: LASSILCAL (KKLC1_HUMAN)
LKSSILCAL

SEQ ID NO: 38860 - protein, 9 aa, Artificial Sequence
  Description of Artificial Sequence: Synthetic peptide
  Seed: LLSKGFRGA (KKLC1_HUMAN)
LLSKGFRGV

SEQ ID NO: 38861 - protein, 9 aa, Artificial Sequence
  Description of Artificial Sequence: Synthetic peptide
  Seed: IVFWKYRRF (KKLC1_HUMAN)
IAFWKYRRW

SEQ ID NO: 38862 - protein, 10 aa, Artificial Sequence
  Description of Artificial Sequence: Synthetic peptide
  Seed: KGFRGASPHR (KKLC1_HUMAN)
KIFRGASPHI

SEQ ID NO: 38863 - protein, 9 aa, Artificial Sequence
  Description of Artificial Sequence: Synthetic peptide
  Seed: KLVELEHTL (KKLC1_HUMAN)
KVVELEHTV

SEQ ID NO: 38864 - protein, 10 aa, Artificial Sequence
  Description of Artificial Sequence: Synthetic peptide
  Seed: YLLLASSILC (KKLC1_HUMAN)
YHLLASSILV

SEQ ID NO: 38865 - protein, 9 aa, Artificial Sequence
  Description of Artificial Sequence: Synthetic peptide
  Seed: FPHSIARQK (KKLC1_HUMAN)
FPHSIARQM

SEQ ID NO: 38866 - protein, 10 aa, Artificial Sequence
  Description of Artificial Sequence: Synthetic peptide
  Seed: QKRILVNLSM (KKLC1_HUMAN)
QMRILVNLSF

SEQ ID NO: 38867 - protein, 9 aa, Artificial Sequence
  Description of Artificial Sequence: Synthetic peptide
  Seed: MVENKLVEL (KKLC1_HUMAN)
MEENKLVEL

SEQ ID NO: 38868 - protein, 10 aa, Artificial Sequence
  Description of Artificial Sequence: Synthetic peptide
  Seed: LASSILCALI (KKLC1_HUMAN)
LVSSILCALV

SEQ ID NO: 38869 - protein, 9 aa, Artificial Sequence
  Description of Artificial Sequence: Synthetic peptide
  Seed: KLVELEHTL (KKLC1_HUMAN)
KWVELEHTI

SEQ ID NO: 38870 - protein, 10 aa, Artificial Sequence
  Description of Artificial Sequence: Synthetic peptide
  Seed: NFYLLLASSI (KKLC1_HUMAN)
NPYLLLASSF

SEQ ID NO: 38871 - protein, 11 aa, Artificial Sequence
  Description of Artificial Sequence: Synthetic peptide
  Seed: RQKRILVNLSM (KKLC1_HUMAN)
RYKRILVNLSR

SEQ ID NO: 38872 - protein, 9 aa, Artificial Sequence
  Description of Artificial Sequence: Synthetic peptide
  Seed: MSSNSTALA (KKLC1_HUMAN)
MQSNSTALV

SEQ ID NO: 38873 - protein, 9 aa, Artificial Sequence
  Description of Artificial Sequence: Synthetic peptide
  Seed: FYLLLASSI (KKLC1_HUMAN)
FYLLLASSL

SEQ ID NO: 38874 - protein, 9 aa, Artificial Sequence
  Description of Artificial Sequence: Synthetic peptide
  Seed: GFRGASPHR (KKLC1_HUMAN)
GLRGASPHK

SEQ ID NO: 38875 - protein, 9 aa, Artificial Sequence
  Description of Artificial Sequence: Synthetic peptide
  Seed: NNFPHSIAR (KKLC1_HUMAN)
NLFPHSIAR

SEQ ID NO: 38876 - protein, 10 aa, Artificial Sequence
  Description of Artificial Sequence: Synthetic peptide
  Seed: QKRILVNLSM (KKLC1_HUMAN)
QYRILVNLSF

SEQ ID NO: 38877 - protein, 10 aa, Artificial Sequence
  Description of Artificial Sequence: Synthetic peptide
  Seed: KRILVNLSMV (KKLC1_HUMAN)
KMILVNLSMV

SEQ ID NO: 38878 - protein, 10 aa, Artificial Sequence
  Description of Artificial Sequence: Synthetic peptide
  Seed: LLLASSILCA (KKLC1_HUMAN)
LMLASSILCI

SEQ ID NO: 38879 - protein, 10 aa, Artificial Sequence
  Description of Artificial Sequence: Synthetic peptide
  Seed: LASSILCALI (KKLC1_HUMAN)
LLSSILCALV

SEQ ID NO: 38880 - protein, 9 aa, Artificial Sequence
  Description of Artificial Sequence: Synthetic peptide
  Seed: AVYDLSRDI (KKLC1_HUMAN)
ASYDLSRDY

SEQ ID NO: 38881 - protein, 9 aa, Artificial Sequence
  Description of Artificial Sequence: Synthetic peptide
  Seed: RRFQRNTGE (KKLC1_HUMAN)
RRFQRNTGW

SEQ ID NO: 38882 - protein, 9 aa, Artificial Sequence
  Description of Artificial Sequence: Synthetic peptide
  Seed: SSNSTALAL (KKLC1_HUMAN)
SDNSTALAM

SEQ ID NO: 38883 - protein, 9 aa, Artificial Sequence
  Description of Artificial Sequence: Synthetic peptide
  Seed: KYRRFQRNT (KKLC1_HUMAN)
KVRRFQRNI

SEQ ID NO: 38884 - protein, 9 aa, Artificial Sequence
  Description of Artificial Sequence: Synthetic peptide
  Seed: KGFRGASPH (KKLC1_HUMAN)
KCFRGASPF

SEQ ID NO: 38885 - protein, 10 aa, Artificial Sequence
  Description of Artificial Sequence: Synthetic peptide
  Seed: GEMSSNSTAL (KKLC1_HUMAN)
GMMSSNSTAA

SEQ ID NO: 38886 - protein, 9 aa, Artificial Sequence
  Description of Artificial Sequence: Synthetic peptide
  Seed: ILNNFPHSI (KKLC1_HUMAN)
IVNNFPHSY

SEQ ID NO: 38887 - protein, 9 aa, Artificial Sequence
  Description of Artificial Sequence: Synthetic peptide
  Seed: MVENKLVEL (KKLC1_HUMAN)
MTENKLVEW

SEQ ID NO: 38888 - protein, 10 aa, Artificial Sequence
  Description of Artificial Sequence: Synthetic peptide
  Seed: FYLLLASSIL (KKLC1_HUMAN)
FMLLLASSII

SEQ ID NO: 38889 - protein, 10 aa, Artificial Sequence
  Description of Artificial Sequence: Synthetic peptide
  Seed: KGFRGASPHR (KKLC1_HUMAN)
KPFRGASPHA

SEQ ID NO: 38890 - protein, 11 aa, Artificial Sequence
  Description of Artificial Sequence: Synthetic peptide
  Seed: RQKRILVNLSM (KKLC1_HUMAN)
RYKRILVNLSV

SEQ ID NO: 38891 - protein, 10 aa, Artificial Sequence
  Description of Artificial Sequence: Synthetic peptide
  Seed: AVYDLSRDIL (KKLC1_HUMAN)
AMYDLSRDII

SEQ ID NO: 38892 - protein, 11 aa, Artificial Sequence
  Description of Artificial Sequence: Synthetic peptide
  Seed: RQKRILVNLSM (KKLC1_HUMAN)
RRKRILVNLSF

SEQ ID NO: 38893 - protein, 10 aa, Artificial Sequence
  Description of Artificial Sequence: Synthetic peptide
  Seed: YLLLASSILC (KKLC1_HUMAN)
YVLLASSILI

SEQ ID NO: 38894 - protein, 10 aa, Artificial Sequence
  Description of Artificial Sequence: Synthetic peptide
  Seed: ILNNFPHSIA (KKLC1_HUMAN)
ILNNFPHSII

SEQ ID NO: 38895 - protein, 9 aa, Artificial Sequence
  Description of Artificial Sequence: Synthetic peptide
  Seed: LLASSILCA (KKLC1_HUMAN)
LQASSILCV

SEQ ID NO: 38896 - protein, 10 aa, Artificial Sequence
  Description of Artificial Sequence: Synthetic peptide
  Seed: ALVRPSSSGL (KKLC1_HUMAN)
APVRPSSSGA

SEQ ID NO: 38897 - protein, 9 aa, Artificial Sequence
  Description of Artificial Sequence: Synthetic peptide
  Seed: KGFRGASPH (KKLC1_HUMAN)
KNFRGASPM

SEQ ID NO: 38898 - protein, 10 aa, Artificial Sequence
  Description of Artificial Sequence: Synthetic peptide
  Seed: QKRILVNLSM (KKLC1_HUMAN)
QHRILVNLSV

SEQ ID NO: 38899 - protein, 9 aa, Artificial Sequence
  Description of Artificial Sequence: Synthetic peptide
  Seed: ILNNFPHSI (KKLC1_HUMAN)
IVNNFPHSM

SEQ ID NO: 38900 - protein, 9 aa, Artificial Sequence
  Description of Artificial Sequence: Synthetic peptide
  Seed: RILVNLSMV (KKLC1_HUMAN)
RTLVNLSMY

SEQ ID NO: 38901 - protein, 11 aa, Artificial Sequence
  Description of Artificial Sequence: Synthetic peptide
  Seed: RQKRILVNLSM (KKLC1_HUMAN)
RYKRILVNLSL

SEQ ID NO: 38902 - protein, 9 aa, Artificial Sequence
  Description of Artificial Sequence: Synthetic peptide
  Seed: SNSTALALV (KKLC1_HUMAN)
SASTALALI

SEQ ID NO: 38903 - protein, 9 aa, Artificial Sequence
  Description of Artificial Sequence: Synthetic peptide
  Seed: VYDLSRDIL (KKLC1_HUMAN)
VVDLSRDIV

SEQ ID NO: 38904 - protein, 11 aa, Artificial Sequence
  Description of Artificial Sequence: Synthetic peptide
  Seed: ASSILCALIVF (KKLC1_HUMAN)
ASSILCALIVW

SEQ ID NO: 38905 - protein, 9 aa, Artificial Sequence
  Description of Artificial Sequence: Synthetic peptide
  Seed: KYRRFQRNT (KKLC1_HUMAN)
KTRRFQRNE

SEQ ID NO: 38906 - protein, 9 aa, Artificial Sequence
  Description of Artificial Sequence: Synthetic peptide
  Seed: SNTDNNLAV (KKLC1_HUMAN)
STTDNNLAF

SEQ ID NO: 38907 - protein, 10 aa, Artificial Sequence
  Description of Artificial Sequence: Synthetic peptide
  Seed: LASSILCALI (KKLC1_HUMAN)
LTSSILCALA

SEQ ID NO: 38908 - protein, 10 aa, Artificial Sequence
  Description of Artificial Sequence: Synthetic peptide
  Seed: VFWKYRRFQR (KKLC1_HUMAN)
VTWKYRRFQR

SEQ ID NO: 38909 - protein, 10 aa, Artificial Sequence
  Description of Artificial Sequence: Synthetic peptide
  Seed: LASSILCALI (KKLC1_HUMAN)
LLSSILCALM

SEQ ID NO: 38910 - protein, 9 aa, Artificial Sequence
  Description of Artificial Sequence: Synthetic peptide
  Seed: RQKRILVNL (KKLC1_HUMAN)
RTKRILVNM

SEQ ID NO: 38911 - protein, 9 aa, Artificial Sequence
  Description of Artificial Sequence: Synthetic peptide
  Seed: ILNNFPHSI (KKLC1_HUMAN)
IRNNFPHSV

SEQ ID NO: 38912 - protein, 10 aa, Artificial Sequence
  Description of Artificial Sequence: Synthetic peptide
  Seed: GEMSSNSTAL (KKLC1_HUMAN)
GEMSSNSTAM

SEQ ID NO: 38913 - protein, 9 aa, Artificial Sequence
  Description of Artificial Sequence: Synthetic peptide
  Seed: RQKRILVNL (KKLC1_HUMAN)
RLKRILVNK

SEQ ID NO: 38914 - protein, 10 aa, Artificial Sequence
  Description of Artificial Sequence: Synthetic peptide
  Seed: GEMSSNSTAL (KKLC1_HUMAN)
GPMSSNSTAV

SEQ ID NO: 38915 - protein, 10 aa, Artificial Sequence
  Description of Artificial Sequence: Synthetic peptide
  Seed: YLLLASSILC (KKLC1_HUMAN)
YQLLASSILI

SEQ ID NO: 38916 - protein, 10 aa, Artificial Sequence
  Description of Artificial Sequence: Synthetic peptide
  Seed: LLASSILCAL (KKLC1_HUMAN)
LLASSILCAA

SEQ ID NO: 38917 - protein, 10 aa, Artificial Sequence
  Description of Artificial Sequence: Synthetic peptide
  Seed: SKGFRGASPH (KKLC1_HUMAN)
SEGFRGASPF

SEQ ID NO: 38918 - protein, 9 aa, Artificial Sequence
  Description of Artificial Sequence: Synthetic peptide
  Seed: YLLLASSIL (KKLC1_HUMAN)
YSLLASSIM

SEQ ID NO: 38919 - protein, 10 aa, Artificial Sequence
  Description of Artificial Sequence: Synthetic peptide
  Seed: SKGFRGASPH (KKLC1_HUMAN)
SLGFRGASPF

SEQ ID NO: 38920 - protein, 9 aa, Artificial Sequence
  Description of Artificial Sequence: Synthetic peptide
  Seed: RFQRNTGEM (KKLC1_HUMAN)
RFQRNTGEF

SEQ ID NO: 38921 - protein, 10 aa, Artificial Sequence
  Description of Artificial Sequence: Synthetic peptide
  Seed: GEMSSNSTAL (KKLC1_HUMAN)
GMMSSNSTAV

SEQ ID NO: 38922 - protein, 10 aa, Artificial Sequence
  Description of Artificial Sequence: Synthetic peptide
  Seed: KYRRFQRNTG (KKLC1_HUMAN)
KTRRFQRNTG

SEQ ID NO: 38923 - protein, 9 aa, Artificial Sequence
  Description of Artificial Sequence: Synthetic peptide
  Seed: RQKRILVNL (KKLC1_HUMAN)
RGKRILVNV

SEQ ID NO: 38924 - protein, 9 aa, Artificial Sequence
  Description of Artificial Sequence: Synthetic peptide
  Seed: SSILCALIV (KKLC1_HUMAN)
SLILCALIV

SEQ ID NO: 38925 - protein, 9 aa, Artificial Sequence
  Description of Artificial Sequence: Synthetic peptide
  Seed: GFRGASPHR (KKLC1_HUMAN)
GTRGASPHA

SEQ ID NO: 38926 - protein, 11 aa, Artificial Sequence
  Description of Artificial Sequence: Synthetic peptide
  Seed: LLLASSILCAL (KKLC1_HUMAN)
LMLASSILCAL

SEQ ID NO: 38927 - protein, 10 aa, Artificial Sequence
  Description of Artificial Sequence: Synthetic peptide
  Seed: EHTLLSKGFR (KKLC1_HUMAN)
EQTLLSKGFR

SEQ ID NO: 38928 - protein, 10 aa, Artificial Sequence
  Description of Artificial Sequence: Synthetic peptide
  Seed: VNLSMVENKL (KKLC1_HUMAN)
VFLSMVENKV

SEQ ID NO: 38929 - protein, 10 aa, Artificial Sequence
  Description of Artificial Sequence: Synthetic peptide
  Seed: FYLLLASSIL (KKLC1_HUMAN)
FMLLLASSIV

SEQ ID NO: 38930 - protein, 9 aa, Artificial Sequence
  Description of Artificial Sequence: Synthetic peptide
  Seed: KYRRFQRNT (KKLC1_HUMAN)
KVRRFQRNS

SEQ ID NO: 38931 - protein, 11 aa, Artificial Sequence
  Description of Artificial Sequence: Synthetic peptide
  Seed: SILCALIVFWK (KKLC1_HUMAN)
SQLCALIVFWR

SEQ ID NO: 38932 - protein, 10 aa, Artificial Sequence
  Description of Artificial Sequence: Synthetic peptide
  Seed: VFWKYRRFQR (KKLC1_HUMAN)
VQWKYRRFQK

SEQ ID NO: 38933 - protein, 10 aa, Artificial Sequence
  Description of Artificial Sequence: Synthetic peptide
  Seed: ALVRPSSSGL (KKLC1_HUMAN)
APVRPSSSGI

SEQ ID NO: 38934 - protein, 11 aa, Artificial Sequence
  Description of Artificial Sequence: Synthetic peptide
  Seed: IVFWKYRRFQR (KKLC1_HUMAN)
IWFWKYRRFQR

SEQ ID NO: 38935 - protein, 9 aa, Artificial Sequence
  Description of Artificial Sequence: Synthetic peptide
  Seed: RQKRILVNL (KKLC1_HUMAN)
RWKRILVNI

SEQ ID NO: 38936 - protein, 11 aa, Artificial Sequence
  Description of Artificial Sequence: Synthetic peptide
  Seed: NNFPHSIARQK (KKLC1_HUMAN)
NSFPHSIARQR

SEQ ID NO: 38937 - protein, 10 aa, Artificial Sequence
  Description of Artificial Sequence: Synthetic peptide
  Seed: GFRGASPHRK (KKLC1_HUMAN)
GMRGASPHRR

SEQ ID NO: 38938 - protein, 8 aa, Artificial Sequence
  Description of Artificial Sequence: Synthetic peptide
  Seed: VYDLSRDI (KKLC1_HUMAN)
VVDLSRDI

SEQ ID NO: 38939 - protein, 9 aa, Artificial Sequence
  Description of Artificial Sequence: Synthetic peptide
  Seed: KLVELEHTL (KKLC1_HUMAN)
KTVELEHTI

SEQ ID NO: 38940 - protein, 9 aa, Artificial Sequence
  Description of Artificial Sequence: Synthetic peptide
  Seed: KYRRFQRNT (KKLC1_HUMAN)
KTRRFQRNK

SEQ ID NO: 38941 - protein, 11 aa, Artificial Sequence
  Description of Artificial Sequence: Synthetic peptide
  Seed: KLVELEHTLLS (KKLC1_HUMAN)
KLVELEHTLLI

SEQ ID NO: 38942 - protein, 9 aa, Artificial Sequence
  Description of Artificial Sequence: Synthetic peptide
  Seed: HTLLSKGFR (KKLC1_HUMAN)
HVLLSKGFK

SEQ ID NO: 38943 - protein, 9 aa, Artificial Sequence
  Description of Artificial Sequence: Synthetic peptide
  Seed: SNTDNNLAV (KKLC1_HUMAN)
STTDNNLAV

SEQ ID NO: 38944 - protein, 9 aa, Artificial Sequence
  Description of Artificial Sequence: Synthetic peptide
  Seed: YLLLASSIL (KKLC1_HUMAN)
YQLLASSIL

SEQ ID NO: 38945 - protein, 10 aa, Artificial Sequence
  Description of Artificial Sequence: Synthetic peptide
  Seed: EHTLLSKGFR (KKLC1_HUMAN)
EMTLLSKGFR

SEQ ID NO: 38946 - protein, 10 aa, Artificial Sequence
  Description of Artificial Sequence: Synthetic peptide
  Seed: LLLASSILCA (KKLC1_HUMAN)
LQLASSILCV

SEQ ID NO: 38947 - protein, 10 aa, Artificial Sequence
  Description of Artificial Sequence: Synthetic peptide
  Seed: DILNNFPHSI (KKLC1_HUMAN)
DTLNNFPHSV

SEQ ID NO: 38948 - protein, 9 aa, Artificial Sequence
  Description of Artificial Sequence: Synthetic peptide
  Seed: KYRRFQRNT (KKLC1_HUMAN)
KVRRFQRNC

SEQ ID NO: 38949 - protein, 9 aa, Artificial Sequence
  Description of Artificial Sequence: Synthetic peptide
  Seed: LASSILCAL (KKLC1_HUMAN)
LVSSILCAM

SEQ ID NO: 38950 - protein, 9 aa, Artificial Sequence
  Description of Artificial Sequence: Synthetic peptide
  Seed: ILNNFPHSI (KKLC1_HUMAN)
IYNNFPHSF

SEQ ID NO: 38951 - protein, 9 aa, Artificial Sequence
  Description of Artificial Sequence: Synthetic peptide
  Seed: FYLLLASSI (KKLC1_HUMAN)
FFLLLASSM

SEQ ID NO: 38952 - protein, 9 aa, Artificial Sequence
  Description of Artificial Sequence: Synthetic peptide
  Seed: LLLASSILC (KKLC1_HUMAN)
LILASSILL

SEQ ID NO: 38953 - protein, 9 aa, Artificial Sequence
  Description of Artificial Sequence: Synthetic peptide
  Seed: RRFQRNTGE (KKLC1_HUMAN)
RRFQRNTGV

SEQ ID NO: 38954 - protein, 10 aa, Artificial Sequence
  Description of Artificial Sequence: Synthetic peptide
  Seed: FYLLLASSIL (KKLC1_HUMAN)
FYLLLASSIW

SEQ ID NO: 38955 - protein, 10 aa, Artificial Sequence
  Description of Artificial Sequence: Synthetic peptide
  Seed: KYRRFQRNTG (KKLC1_HUMAN)
KTRRFQRNTT

SEQ ID NO: 38956 - protein, 10 aa, Artificial Sequence
  Description of Artificial Sequence: Synthetic peptide
  Seed: GEMSSNSTAL (KKLC1_HUMAN)
GKMSSNSTAF

SEQ ID NO: 38957 - protein, 9 aa, Artificial Sequence
  Description of Artificial Sequence: Synthetic peptide
  Seed: KLVELEHTL (KKLC1_HUMAN)
KQVELEHTI

SEQ ID NO: 38958 - protein, 11 aa, Artificial Sequence
  Description of Artificial Sequence: Synthetic peptide
  Seed: RQKRILVNLSM (KKLC1_HUMAN)
RHKRILVNLSL

SEQ ID NO: 38959 - protein, 11 aa, Artificial Sequence
  Description of Artificial Sequence: Synthetic peptide
  Seed: RQKRILVNLSM (KKLC1_HUMAN)
RYKRILVNLSM

SEQ ID NO: 38960 - protein, 10 aa, Artificial Sequence
  Description of Artificial Sequence: Synthetic peptide
  Seed: DILNNFPHSI (KKLC1_HUMAN)
DKLNNFPHSV

SEQ ID NO: 38961 - protein, 10 aa, Artificial Sequence
  Description of Artificial Sequence: Synthetic peptide
  Seed: VFWKYRRFQR (KKLC1_HUMAN)
VAWKYRRFQR

SEQ ID NO: 38962 - protein, 10 aa, Artificial Sequence
  Description of Artificial Sequence: Synthetic peptide
  Seed: LASSILCALI (KKLC1_HUMAN)
LLSSILCALR

SEQ ID NO: 38963 - protein, 9 aa, Artificial Sequence
  Description of Artificial Sequence: Synthetic peptide
  Seed: AVYDLSRDI (KKLC1_HUMAN)
ATYDLSRDL

SEQ ID NO: 38964 - protein, 11 aa, Artificial Sequence
  Description of Artificial Sequence: Synthetic peptide
  Seed: MNFYLLLASSI (KKLC1_HUMAN)
MDFYLLLASSF

SEQ ID NO: 38965 - protein, 9 aa, Artificial Sequence
  Description of Artificial Sequence: Synthetic peptide
  Seed: KLVELEHTL (KKLC1_HUMAN)
KPVELEHTY

SEQ ID NO: 38966 - protein, 10 aa, Artificial Sequence
  Description of Artificial Sequence: Synthetic peptide
  Seed: KGFRGASPHR (KKLC1_HUMAN)
KTFRGASPHY

SEQ ID NO: 38967 - protein, 10 aa, Artificial Sequence
  Description of Artificial Sequence: Synthetic peptide
  Seed: LLASSILCAL (KKLC1_HUMAN)
LTASSILCAV

SEQ ID NO: 38968 - protein, 10 aa, Artificial Sequence
  Description of Artificial Sequence: Synthetic peptide
  Seed: EMSSNSTALA (KKLC1_HUMAN)
EGSSNSTALV

SEQ ID NO: 38969 - protein, 9 aa, Artificial Sequence
  Description of Artificial Sequence: Synthetic peptide
  Seed: KGFRGASPH (KKLC1_HUMAN)
KQFRGASPV

SEQ ID NO: 38970 - protein, 10 aa, Artificial Sequence
  Description of Artificial Sequence: Synthetic peptide
  Seed: RQKRILVNLS (KKLC1_HUMAN)
RVKRILVNLS

SEQ ID NO: 38971 - protein, 10 aa, Artificial Sequence
  Description of Artificial Sequence: Synthetic peptide
  Seed: RRFQRNTGEM (KKLC1_HUMAN)
RHFQRNTGEY

SEQ ID NO: 38972 - protein, 9 aa, Artificial Sequence
  Description of Artificial Sequence: Synthetic peptide
  Seed: YLLLASSIL (KKLC1_HUMAN)
YILLASSIV

SEQ ID NO: 38973 - protein, 10 aa, Artificial Sequence
  Description of Artificial Sequence: Synthetic peptide
  Seed: DILNNFPHSI (KKLC1_HUMAN)
DVLNNFPHSV

SEQ ID NO: 38974 - protein, 9 aa, Artificial Sequence
  Description of Artificial Sequence: Synthetic peptide
  Seed: LVRPSSSGL (KKLC1_HUMAN)
LSRPSSSGY

SEQ ID NO: 38975 - protein, 11 aa, Artificial Sequence
  Description of Artificial Sequence: Synthetic peptide
  Seed: MSSNSTALALV (KKLC1_HUMAN)
MISNSTALALW

SEQ ID NO: 38976 - protein, 9 aa, Artificial Sequence
  Description of Artificial Sequence: Synthetic peptide
  Seed: GFRGASPHR (KKLC1_HUMAN)
GTRGASPHK

SEQ ID NO: 38977 - protein, 10 aa, Artificial Sequence
  Description of Artificial Sequence: Synthetic peptide
  Seed: MSSNSTALAL (KKLC1_HUMAN)
MISNSTALAV

SEQ ID NO: 38978 - protein, 11 aa, Artificial Sequence
  Description of Artificial Sequence: Synthetic peptide
  Seed: KGFRGASPHRK (KKLC1_HUMAN)
KTFRGASPHRK

SEQ ID NO: 38979 - protein, 10 aa, Artificial Sequence
  Description of Artificial Sequence: Synthetic peptide
  Seed: QKRILVNLSM (KKLC1_HUMAN)
QGRILVNLSL

SEQ ID NO: 38980 - protein, 10 aa, Artificial Sequence
  Description of Artificial Sequence: Synthetic peptide
  Seed: KGFRGASPHR (KKLC1_HUMAN)
KSFRGASPHI

SEQ ID NO: 38981 - protein, 11 aa, Artificial Sequence
  Description of Artificial Sequence: Synthetic peptide
  Seed: RQKRILVNLSM (KKLC1_HUMAN)
RKKRILVNLSV

SEQ ID NO: 38982 - protein, 10 aa, Artificial Sequence
  Description of Artificial Sequence: Synthetic peptide
  Seed: SKGFRGASPH (KKLC1_HUMAN)
SMGFRGASPY

SEQ ID NO: 38983 - protein, 9 aa, Artificial Sequence
  Description of Artificial Sequence: Synthetic peptide
  Seed: FWKYRRFQR (KKLC1_HUMAN)
FSKYRRFQK

SEQ ID NO: 38984 - protein, 9 aa, Artificial Sequence
  Description of Artificial Sequence: Synthetic peptide
  Seed: RQKRILVNL (KKLC1_HUMAN)
RLKRILVNS

SEQ ID NO: 38985 - protein, 9 aa, Artificial Sequence
  Description of Artificial Sequence: Synthetic peptide
  Seed: RQKRILVNL (KKLC1_HUMAN)
RLKRILVNW

SEQ ID NO: 38986 - protein, 9 aa, Artificial Sequence
  Description of Artificial Sequence: Synthetic peptide
  Seed: LVRPSSSGL (KKLC1_HUMAN)
LIRPSSSGY

SEQ ID NO: 38987 - protein, 9 aa, Artificial Sequence
  Description of Artificial Sequence: Synthetic peptide
  Seed: KLVELEHTL (KKLC1_HUMAN)
KMVELEHTR

SEQ ID NO: 38988 - protein, 11 aa, Artificial Sequence
  Description of Artificial Sequence: Synthetic peptide
  Seed: LSMVENKLVEL (KKLC1_HUMAN)
LVMVENKLVEW

SEQ ID NO: 38989 - protein, 9 aa, Artificial Sequence
  Description of Artificial Sequence: Synthetic peptide
  Seed: LLASSILCA (KKLC1_HUMAN)
LVASSILCV

SEQ ID NO: 38990 - protein, 9 aa, Artificial Sequence
  Description of Artificial Sequence: Synthetic peptide
  Seed: KLVELEHTL (KKLC1_HUMAN)
KIVELEHTY

SEQ ID NO: 38991 - protein, 9 aa, Artificial Sequence
  Description of Artificial Sequence: Synthetic peptide
  Seed: IARQKRILV (KKLC1_HUMAN)
ITRQKRILK

SEQ ID NO: 38992 - protein, 10 aa, Artificial Sequence
  Description of Artificial Sequence: Synthetic peptide
  Seed: YLLLASSILC (KKLC1_HUMAN)
YILLASSILL

SEQ ID NO: 38993 - protein, 10 aa, Artificial Sequence
  Description of Artificial Sequence: Synthetic peptide
  Seed: SKGFRGASPH (KKLC1_HUMAN)
SQGFRGASPY

SEQ ID NO: 38994 - protein, 9 aa, Artificial Sequence
  Description of Artificial Sequence: Synthetic peptide
  Seed: ILNNFPHSI (KKLC1_HUMAN)
IVNNFPHSF

SEQ ID NO: 38995 - protein, 9 aa, Artificial Sequence
  Description of Artificial Sequence: Synthetic peptide
  Seed: LVRPSSSGL (KKLC1_HUMAN)
LPRPSSSGP

SEQ ID NO: 38996 - protein, 9 aa, Artificial Sequence
  Description of Artificial Sequence: Synthetic peptide
  Seed: KLVELEHTL (KKLC1_HUMAN)
KDVELEHTV

SEQ ID NO: 38997 - protein, 9 aa, Artificial Sequence
  Description of Artificial Sequence: Synthetic peptide
  Seed: RQKRILVNL (KKLC1_HUMAN)
RSKRILVNI

SEQ ID NO: 38998 - protein, 9 aa, Artificial Sequence
  Description of Artificial Sequence: Synthetic peptide
  Seed: RQKRILVNL (KKLC1_HUMAN)
RVKRILVNR

SEQ ID NO: 38999 - protein, 10 aa, Artificial Sequence
  Description of Artificial Sequence: Synthetic peptide
  Seed: MSSNSTALAL (KKLC1_HUMAN)
MMSNSTALAW

SEQ ID NO: 39000 - protein, 10 aa, Artificial Sequence
  Description of Artificial Sequence: Synthetic peptide
  Seed: YLLLASSILC (KKLC1_HUMAN)
YILLASSILI

SEQ ID NO: 39001 - protein, 9 aa, Artificial Sequence
  Description of Artificial Sequence: Synthetic peptide
  Seed: NLSMVENKL (KKLC1_HUMAN)
NQSMVENKI

SEQ ID NO: 39002 - protein, 9 aa, Artificial Sequence
  Description of Artificial Sequence: Synthetic peptide
  Seed: RQKRILVNL (KKLC1_HUMAN)
RAKRILVNI

SEQ ID NO: 39003 - protein, 11 aa, Artificial Sequence
  Description of Artificial Sequence: Synthetic peptide
  Seed: RQKRILVNLSM (KKLC1_HUMAN)
RCKRILVNLSM

SEQ ID NO: 39004 - protein, 9 aa, Artificial Sequence
  Description of Artificial Sequence: Synthetic peptide
  Seed: KYRRFQRNT (KKLC1_HUMAN)
KMRRFQRNK

SEQ ID NO: 39005 - protein, 8 aa, Artificial Sequence
  Description of Artificial Sequence: Synthetic peptide
  Seed: VYDLSRDI (KKLC1_HUMAN)
VYDLSRDL

SEQ ID NO: 39006 - protein, 11 aa, Artificial Sequence
  Description of Artificial Sequence: Synthetic peptide
  Seed: IVFWKYRRFQR (KKLC1_HUMAN)
IQFWKYRRFQR

SEQ ID NO: 39007 - protein, 10 aa, Artificial Sequence
  Description of Artificial Sequence: Synthetic peptide
  Seed: ALIVFWKYRR (KKLC1_HUMAN)
AGIVFWKYRR

SEQ ID NO: 39008 - protein, 9 aa, Artificial Sequence
  Description of Artificial Sequence: Synthetic peptide
  Seed: MSSNSTALA (KKLC1_HUMAN)
MQSNSTALA

SEQ ID NO: 39009 - protein, 10 aa, Artificial Sequence
  Description of Artificial Sequence: Synthetic peptide
  Seed: SKGFRGASPH (KKLC1_HUMAN)
SKGFRGASPM

SEQ ID NO: 39010 - protein, 9 aa, Artificial Sequence
  Description of Artificial Sequence: Synthetic peptide
  Seed: NTDNNLAVY (KKLC1_HUMAN)
NMDNNLAVL

SEQ ID NO: 39011 - protein, 9 aa, Artificial Sequence
  Description of Artificial Sequence: Synthetic peptide
  Seed: ILNNFPHSI (KKLC1_HUMAN)
IRNNFPHSI

SEQ ID NO: 39012 - protein, 9 aa, Artificial Sequence
  Description of Artificial Sequence: Synthetic peptide
  Seed: ASSILCALI (KKLC1_HUMAN)
ALSILCALL

SEQ ID NO: 39013 - protein, 11 aa, Artificial Sequence
  Description of Artificial Sequence: Synthetic peptide
  Seed: RQKRILVNLSM (KKLC1_HUMAN)
RQKRILVNLSV

SEQ ID NO: 39014 - protein, 9 aa, Artificial Sequence
  Description of Artificial Sequence: Synthetic peptide
  Seed: KYRRFQRNT (KKLC1_HUMAN)
KGRRFQRNA

SEQ ID NO: 39015 - protein, 9 aa, Artificial Sequence
  Description of Artificial Sequence: Synthetic peptide
  Seed: KLVELEHTL (KKLC1_HUMAN)
KFVELEHTI

SEQ ID NO: 39016 - protein, 9 aa, Artificial Sequence
  Description of Artificial Sequence: Synthetic peptide
  Seed: RILVNLSMV (KKLC1_HUMAN)
RTLVNLSMW

SEQ ID NO: 39017 - protein, 11 aa, Artificial Sequence
  Description of Artificial Sequence: Synthetic peptide
  Seed: GLINSNTDNNL (KKLC1_HUMAN)
GQINSNTDNNF

SEQ ID NO: 39018 - protein, 9 aa, Artificial Sequence
  Description of Artificial Sequence: Synthetic peptide
  Seed: LVRPSSSGL (KKLC1_HUMAN)
LARPSSSGW

SEQ ID NO: 39019 - protein, 9 aa, Artificial Sequence
  Description of Artificial Sequence: Synthetic peptide
  Seed: SNSTALALV (KKLC1_HUMAN)
SVSTALALV

SEQ ID NO: 39020 - protein, 10 aa, Artificial Sequence
  Description of Artificial Sequence: Synthetic peptide
  Seed: NFYLLLASSI (KKLC1_HUMAN)
NMYLLLASSF

SEQ ID NO: 39021 - protein, 10 aa, Artificial Sequence
  Description of Artificial Sequence: Synthetic peptide
  Seed: MSSNSTALAL (KKLC1_HUMAN)
MGSNSTALAW

SEQ ID NO: 39022 - protein, 9 aa, Artificial Sequence
  Description of Artificial Sequence: Synthetic peptide
  Seed: AVYDLSRDI (KKLC1_HUMAN)
AAYDLSRDF

SEQ ID NO: 39023 - protein, 9 aa, Artificial Sequence
  Description of Artificial Sequence: Synthetic peptide
  Seed: NNFPHSIAR (KKLC1_HUMAN)
NWFPHSIAR

SEQ ID NO: 39024 - protein, 9 aa, Artificial Sequence
  Description of Artificial Sequence: Synthetic peptide
  Seed: LASSILCAL (KKLC1_HUMAN)
LISSILCAY

SEQ ID NO: 39025 - protein, 9 aa, Artificial Sequence
  Description of Artificial Sequence: Synthetic peptide
  Seed: VYDLSRDIL (KKLC1_HUMAN)
VQDLSRDIM

SEQ ID NO: 39026 - protein, 9 aa, Artificial Sequence
  Description of Artificial Sequence: Synthetic peptide
  Seed: AVYDLSRDI (KKLC1_HUMAN)
AQYDLSRDV

SEQ ID NO: 39027 - protein, 9 aa, Artificial Sequence
  Description of Artificial Sequence: Synthetic peptide
  Seed: EMSSNSTAL (KKLC1_HUMAN)
ERSSNSTAL

SEQ ID NO: 39028 - protein, 9 aa, Artificial Sequence
  Description of Artificial Sequence: Synthetic peptide
  Seed: ALIVFWKYR (KKLC1_HUMAN)
AWIVFWKYK

SEQ ID NO: 39029 - protein, 10 aa, Artificial Sequence
  Description of Artificial Sequence: Synthetic peptide
  Seed: DILNNFPHSI (KKLC1_HUMAN)
DYLNNFPHSV

SEQ ID NO: 39030 - protein, 9 aa, Artificial Sequence
  Description of Artificial Sequence: Synthetic peptide
  Seed: LASSILCAL (KKLC1_HUMAN)
LMSSILCAI

SEQ ID NO: 39031 - protein, 10 aa, Artificial Sequence
  Description of Artificial Sequence: Synthetic peptide
  Seed: GEMSSNSTAL (KKLC1_HUMAN)
GFMSSNSTAL

SEQ ID NO: 39032 - protein, 9 aa, Artificial Sequence
  Description of Artificial Sequence: Synthetic peptide
  Seed: IVFWKYRRF (KKLC1_HUMAN)
ISFWKYRRY

SEQ ID NO: 39033 - protein, 10 aa, Artificial Sequence
  Description of Artificial Sequence: Synthetic peptide
  Seed: SNTDNNLAVY (KKLC1_HUMAN)
SQTDNNLAVF

SEQ ID NO: 39034 - protein, 11 aa, Artificial Sequence
  Description of Artificial Sequence: Synthetic peptide
  Seed: NNFPHSIARQK (KKLC1_HUMAN)
NLFPHSIARQR

SEQ ID NO: 39035 - protein, 11 aa, Artificial Sequence
  Description of Artificial Sequence: Synthetic peptide
  Seed: KLVELEHTLLS (KKLC1_HUMAN)
KLVELEHTLLA

SEQ ID NO: 39036 - protein, 9 aa, Artificial Sequence
  Description of Artificial Sequence: Synthetic peptide
  Seed: SILCALIVF (KKLC1_HUMAN)
SQLCALIVL

SEQ ID NO: 39037 - protein, 10 aa, Artificial Sequence
  Description of Artificial Sequence: Synthetic peptide
  Seed: SMVENKLVEL (KKLC1_HUMAN)
SKVENKLVEY

SEQ ID NO: 39038 - protein, 9 aa, Artificial Sequence
  Description of Artificial Sequence: Synthetic peptide
  Seed: GFRGASPHR (KKLC1_HUMAN)
GSRGASPHV

SEQ ID NO: 39039 - protein, 9 aa, Artificial Sequence
  Description of Artificial Sequence: Synthetic peptide
  Seed: KLVELEHTL (KKLC1_HUMAN)
KAVELEHTV

SEQ ID NO: 39040 - protein, 11 aa, Artificial Sequence
  Description of Artificial Sequence: Synthetic peptide
  Seed: RDILNNFPHSI (KKLC1_HUMAN)
RAILNNFPHSV

SEQ ID NO: 39041 - protein, 10 aa, Artificial Sequence
  Description of Artificial Sequence: Synthetic peptide
  Seed: SNTDNNLAVY (KKLC1_HUMAN)
SVTDNNLAVY

SEQ ID NO: 39042 - protein, 11 aa, Artificial Sequence
  Description of Artificial Sequence: Synthetic peptide
  Seed: RRFQRNTGEMS (KKLC1_HUMAN)
RRFQRNTGEMY

SEQ ID NO: 39043 - protein, 10 aa, Artificial Sequence
  Description of Artificial Sequence: Synthetic peptide
  Seed: MSSNSTALAL (KKLC1_HUMAN)
MLSNSTALAA

SEQ ID NO: 39044 - protein, 8 aa, Artificial Sequence
  Description of Artificial Sequence: Synthetic peptide
  Seed: VYDLSRDI (KKLC1_HUMAN)
VSDLSRDM

SEQ ID NO: 39045 - protein, 11 aa, Artificial Sequence
  Description of Artificial Sequence: Synthetic peptide
  Seed: ASSILCALIVF (KKLC1_HUMAN)
ATSILCALIVW

SEQ ID NO: 39046 - protein, 9 aa, Artificial Sequence
  Description of Artificial Sequence: Synthetic peptide
  Seed: RQKRILVNL (KKLC1_HUMAN)
RVKRILVNF

SEQ ID NO: 39047 - protein, 9 aa, Artificial Sequence
  Description of Artificial Sequence: Synthetic peptide
  Seed: ILNNFPHSI (KKLC1_HUMAN)
IQNNFPHSL

SEQ ID NO: 39048 - protein, 9 aa, Artificial Sequence
  Description of Artificial Sequence: Synthetic peptide
  Seed: NLSMVENKL (KKLC1_HUMAN)
NQSMVENKF

SEQ ID NO: 39049 - protein, 9 aa, Artificial Sequence
  Description of Artificial Sequence: Synthetic peptide
  Seed: VYDLSRDIL (KKLC1_HUMAN)
VFDLSRDIM

SEQ ID NO: 39050 - protein, 9 aa, Artificial Sequence
  Description of Artificial Sequence: Synthetic peptide
  Seed: LASSILCAL (KKLC1_HUMAN)
LQSSILCAW

SEQ ID NO: 39051 - protein, 10 aa, Artificial Sequence
  Description of Artificial Sequence: Synthetic peptide
  Seed: ILNNFPHSIA (KKLC1_HUMAN)
IMNNFPHSIV

SEQ ID NO: 39052 - protein, 10 aa, Artificial Sequence
  Description of Artificial Sequence: Synthetic peptide
  Seed: CALIVFWKYR (KKLC1_HUMAN)
CQLIVFWKYR

SEQ ID NO: 39053 - protein, 9 aa, Artificial Sequence
  Description of Artificial Sequence: Synthetic peptide
  Seed: SILCALIVF (KKLC1_HUMAN)
SALCALIVW

SEQ ID NO: 39054 - protein, 10 aa, Artificial Sequence
  Description of Artificial Sequence: Synthetic peptide
  Seed: RRFQRNTGEM (KKLC1_HUMAN)
RRFQRNTGEV

SEQ ID NO: 39055 - protein, 10 aa, Artificial Sequence
  Description of Artificial Sequence: Synthetic peptide
  Seed: YLLLASSILC (KKLC1_HUMAN)
YILLASSILA

SEQ ID NO: 39056 - protein, 9 aa, Artificial Sequence
  Description of Artificial Sequence: Synthetic peptide
  Seed: GEMSSNSTA (KKLC1_HUMAN)
GEMSSNSTY

SEQ ID NO: 39057 - protein, 9 aa, Artificial Sequence
  Description of Artificial Sequence: Synthetic peptide
  Seed: ILNNFPHSI (KKLC1_HUMAN)
IINNFPHSI

SEQ ID NO: 39058 - protein, 11 aa, Artificial Sequence
  Description of Artificial Sequence: Synthetic peptide
  Seed: RRFQRNTGEMS (KKLC1_HUMAN)
RRFQRNTGEMR

SEQ ID NO: 39059 - protein, 9 aa, Artificial Sequence
  Description of Artificial Sequence: Synthetic peptide
  Seed: LVRPSSSGL (KKLC1_HUMAN)
LTRPSSSGA

SEQ ID NO: 39060 - protein, 10 aa, Artificial Sequence
  Description of Artificial Sequence: Synthetic peptide
  Seed: ALIVFWKYRR (KKLC1_HUMAN)
AIIVFWKYRR

SEQ ID NO: 39061 - protein, 11 aa, Artificial Sequence
  Description of Artificial Sequence: Synthetic peptide
  Seed: YLLLASSILCA (KKLC1_HUMAN)
YRLLASSILCL

SEQ ID NO: 39062 - protein, 10 aa, Artificial Sequence
  Description of Artificial Sequence: Synthetic peptide
  Seed: LLASSILCAL (KKLC1_HUMAN)
LIASSILCAF

SEQ ID NO: 39063 - protein, 11 aa, Artificial Sequence
  Description of Artificial Sequence: Synthetic peptide
  Seed: RQKRILVNLSM (KKLC1_HUMAN)
RQKRILVNLSF

SEQ ID NO: 39064 - protein, 10 aa, Artificial Sequence
  Description of Artificial Sequence: Synthetic peptide
  Seed: KGFRGASPHR (KKLC1_HUMAN)
KTFRGASPHI

SEQ ID NO: 39065 - protein, 10 aa, Artificial Sequence
  Description of Artificial Sequence: Synthetic peptide
  Seed: RRFQRNTGEM (KKLC1_HUMAN)
RKFQRNTGEM

SEQ ID NO: 39066 - protein, 11 aa, Artificial Sequence
  Description of Artificial Sequence: Synthetic peptide
  Seed: KGFRGASPHRK (KKLC1_HUMAN)
KIFRGASPHRK

SEQ ID NO: 39067 - protein, 10 aa, Artificial Sequence
  Description of Artificial Sequence: Synthetic peptide
  Seed: KYRRFQRNTG (KKLC1_HUMAN)
KTRRFQRNTI

SEQ ID NO: 39068 - protein, 10 aa, Artificial Sequence
  Description of Artificial Sequence: Synthetic peptide
  Seed: QKRILVNLSM (KKLC1_HUMAN)
QSRILVNLSF

SEQ ID NO: 39069 - protein, 9 aa, Artificial Sequence
  Description of Artificial Sequence: Synthetic peptide
  Seed: KYRRFQRNT (KKLC1_HUMAN)
KYRRFQRNI

SEQ ID NO: 39070 - protein, 10 aa, Artificial Sequence
  Description of Artificial Sequence: Synthetic peptide
  Seed: ALVRPSSSGL (KKLC1_HUMAN)
ARVRPSSSGK

SEQ ID NO: 39071 - protein, 9 aa, Artificial Sequence
  Description of Artificial Sequence: Synthetic peptide
  Seed: NNFPHSIAR (KKLC1_HUMAN)
NAFPHSIAA

SEQ ID NO: 39072 - protein, 11 aa, Artificial Sequence
  Description of Artificial Sequence: Synthetic peptide
  Seed: YLLLASSILCA (KKLC1_HUMAN)
YYLLASSILCV

SEQ ID NO: 39073 - protein, 10 aa, Artificial Sequence
  Description of Artificial Sequence: Synthetic peptide
  Seed: GEMSSNSTAL (KKLC1_HUMAN)
GRMSSNSTAV

SEQ ID NO: 39074 - protein, 10 aa, Artificial Sequence
  Description of Artificial Sequence: Synthetic peptide
  Seed: EMSSNSTALA (KKLC1_HUMAN)
EDSSNSTALV

SEQ ID NO: 39075 - protein, 10 aa, Artificial Sequence
  Description of Artificial Sequence: Synthetic peptide
  Seed: LASSILCALI (KKLC1_HUMAN)
LTSSILCALF

SEQ ID NO: 39076 - protein, 9 aa, Artificial Sequence
  Description of Artificial Sequence: Synthetic peptide
  Seed: SILCALIVF (KKLC1_HUMAN)
SHLCALIVF

SEQ ID NO: 39077 - protein, 9 aa, Artificial Sequence
  Description of Artificial Sequence: Synthetic peptide
  Seed: SILCALIVF (KKLC1_HUMAN)
SSLCALIVY

SEQ ID NO: 39078 - protein, 10 aa, Artificial Sequence
  Description of Artificial Sequence: Synthetic peptide
  Seed: ILCALIVFWK (KKLC1_HUMAN)
ISCALIVFWK

SEQ ID NO: 39079 - protein, 9 aa, Artificial Sequence
  Description of Artificial Sequence: Synthetic peptide
  Seed: KRILVNLSM (KKLC1_HUMAN)
KLILVNLSF

SEQ ID NO: 39080 - protein, 10 aa, Artificial Sequence
  Description of Artificial Sequence: Synthetic peptide
  Seed: KYRRFQRNTG (KKLC1_HUMAN)
KTRRFQRNTA

SEQ ID NO: 39081 - protein, 9 aa, Artificial Sequence
  Description of Artificial Sequence: Synthetic peptide
  Seed: KGFRGASPH (KKLC1_HUMAN)
KAFRGASPM

SEQ ID NO: 39082 - protein, 9 aa, Artificial Sequence
  Description of Artificial Sequence: Synthetic peptide
  Seed: LSMVENKLV (KKLC1_HUMAN)
LIMVENKLW

SEQ ID NO: 39083 - protein, 10 aa, Artificial Sequence
  Description of Artificial Sequence: Synthetic peptide
  Seed: VELEHTLLSK (KKLC1_HUMAN)
VMLEHTLLSR

SEQ ID NO: 39084 - protein, 9 aa, Artificial Sequence
  Description of Artificial Sequence: Synthetic peptide
  Seed: SSNSTALAL (KKLC1_HUMAN)
SPNSTALAV

SEQ ID NO: 39085 - protein, 10 aa, Artificial Sequence
  Description of Artificial Sequence: Synthetic peptide
  Seed: GEMSSNSTAL (KKLC1_HUMAN)
GRMSSNSTAF

SEQ ID NO: 39086 - protein, 10 aa, Artificial Sequence
  Description of Artificial Sequence: Synthetic peptide
  Seed: QKRILVNLSM (KKLC1_HUMAN)
QQRILVNLSF

SEQ ID NO: 39087 - protein, 10 aa, Artificial Sequence
  Description of Artificial Sequence: Synthetic peptide
  Seed: RQKRILVNLS (KKLC1_HUMAN)
RLKRILVNLK

SEQ ID NO: 39088 - protein, 9 aa, Artificial Sequence
  Description of Artificial Sequence: Synthetic peptide
  Seed: LSRDILNNF (KKLC1_HUMAN)
LIRDILNNY

SEQ ID NO: 39089 - protein, 10 aa, Artificial Sequence
  Description of Artificial Sequence: Synthetic peptide
  Seed: KYRRFQRNTG (KKLC1_HUMAN)
KGRRFQRNTK

SEQ ID NO: 39090 - protein, 9 aa, Artificial Sequence
  Description of Artificial Sequence: Synthetic peptide
  Seed: RQKRILVNL (KKLC1_HUMAN)
RTKRILVNA

SEQ ID NO: 39091 - protein, 10 aa, Artificial Sequence
  Description of Artificial Sequence: Synthetic peptide
  Seed: LASSILCALI (KKLC1_HUMAN)
LSSSILCALY

SEQ ID NO: 39092 - protein, 9 aa, Artificial Sequence
  Description of Artificial Sequence: Synthetic peptide
  Seed: RQKRILVNL (KKLC1_HUMAN)
RSKRILVNV

SEQ ID NO: 39093 - protein, 10 aa, Artificial Sequence
  Description of Artificial Sequence: Synthetic peptide
  Seed: ALIVFWKYRR (KKLC1_HUMAN)
ATIVFWKYRK

SEQ ID NO: 39094 - protein, 10 aa, Artificial Sequence
  Description of Artificial Sequence: Synthetic peptide
  Seed: NFYLLLASSI (KKLC1_HUMAN)
NNYLLLASSF

SEQ ID NO: 39095 - protein, 11 aa, Artificial Sequence
  Description of Artificial Sequence: Synthetic peptide
  Seed: VFWKYRRFQRN (KKLC1_HUMAN)
VVWKYRRFQRR

SEQ ID NO: 39096 - protein, 9 aa, Artificial Sequence
  Description of Artificial Sequence: Synthetic peptide
  Seed: IVFWKYRRF (KKLC1_HUMAN)
ISFWKYRRW

SEQ ID NO: 39097 - protein, 9 aa, Artificial Sequence
  Description of Artificial Sequence: Synthetic peptide
  Seed: KLVELEHTL (KKLC1_HUMAN)
KEVELEHTF

SEQ ID NO: 39098 - protein, 9 aa, Artificial Sequence
  Description of Artificial Sequence: Synthetic peptide
  Seed: KLVELEHTL (KKLC1_HUMAN)
KAVELEHTM

SEQ ID NO: 39099 - protein, 10 aa, Artificial Sequence
  Description of Artificial Sequence: Synthetic peptide
  Seed: TGEMSSNSTA (KKLC1_HUMAN)
TWEMSSNSTA

SEQ ID NO: 39100 - protein, 9 aa, Artificial Sequence
  Description of Artificial Sequence: Synthetic peptide
  Seed: SSNSTALAL (KKLC1_HUMAN)
SVNSTALAM

SEQ ID NO: 39101 - protein, 9 aa, Artificial Sequence
  Description of Artificial Sequence: Synthetic peptide
  Seed: LLASSILCA (KKLC1_HUMAN)
LQASSILCI

SEQ ID NO: 39102 - protein, 9 aa, Artificial Sequence
  Description of Artificial Sequence: Synthetic peptide
  Seed: KYRRFQRNT (KKLC1_HUMAN)
KTRRFQRNI

SEQ ID NO: 39103 - protein, 10 aa, Artificial Sequence
  Description of Artificial Sequence: Synthetic peptide
  Seed: FYLLLASSIL (KKLC1_HUMAN)
FGLLLASSIV

SEQ ID NO: 39104 - protein, 9 aa, Artificial Sequence
  Description of Artificial Sequence: Synthetic peptide
  Seed: ILNNFPHSI (KKLC1_HUMAN)
ISNNFPHSI

SEQ ID NO: 39105 - protein, 10 aa, Artificial Sequence
  Description of Artificial Sequence: Synthetic peptide
  Seed: QKRILVNLSM (KKLC1_HUMAN)
QTRILVNLSI

SEQ ID NO: 39106 - protein, 10 aa, Artificial Sequence
  Description of Artificial Sequence: Synthetic peptide
  Seed: QKRILVNLSM (KKLC1_HUMAN)
QLRILVNLSM

SEQ ID NO: 39107 - protein, 9 aa, Artificial Sequence
  Description of Artificial Sequence: Synthetic peptide
  Seed: FPHSIARQK (KKLC1_HUMAN)
FPHSIARQL

SEQ ID NO: 39108 - protein, 9 aa, Artificial Sequence
  Description of Artificial Sequence: Synthetic peptide
  Seed: IARQKRILV (KKLC1_HUMAN)
IARQKRILW

SEQ ID NO: 39109 - protein, 10 aa, Artificial Sequence
  Description of Artificial Sequence: Synthetic peptide
  Seed: ILCALIVFWK (KKLC1_HUMAN)
IACALIVFWR

SEQ ID NO: 39110 - protein, 10 aa, Artificial Sequence
  Description of Artificial Sequence: Synthetic peptide
  Seed: QKRILVNLSM (KKLC1_HUMAN)
QNRILVNLSV

SEQ ID NO: 39111 - protein, 10 aa, Artificial Sequence
  Description of Artificial Sequence: Synthetic peptide
  Seed: KYRRFQRNTG (KKLC1_HUMAN)
KMRRFQRNTK

SEQ ID NO: 39112 - protein, 9 aa, Artificial Sequence
  Description of Artificial Sequence: Synthetic peptide
  Seed: LASSILCAL (KKLC1_HUMAN)
LASSILCAI

SEQ ID NO: 39113 - protein, 10 aa, Artificial Sequence
  Description of Artificial Sequence: Synthetic peptide
  Seed: KGFRGASPHR (KKLC1_HUMAN)
KSFRGASPHL

SEQ ID NO: 39114 - protein, 9 aa, Artificial Sequence
  Description of Artificial Sequence: Synthetic peptide
  Seed: NNFPHSIAR (KKLC1_HUMAN)
NMFPHSIAR

SEQ ID NO: 39115 - protein, 9 aa, Artificial Sequence
  Description of Artificial Sequence: Synthetic peptide
  Seed: LSRDILNNF (KKLC1_HUMAN)
LVRDILNNY

SEQ ID NO: 39116 - protein, 9 aa, Artificial Sequence
  Description of Artificial Sequence: Synthetic peptide
  Seed: NNFPHSIAR (KKLC1_HUMAN)
NFFPHSIAF

SEQ ID NO: 39117 - protein, 10 aa, Artificial Sequence
  Description of Artificial Sequence: Synthetic peptide
  Seed: LVNLSMVENK (KKLC1_HUMAN)
LMNLSMVENK

SEQ ID NO: 39118 - protein, 10 aa, Artificial Sequence
  Description of Artificial Sequence: Synthetic peptide
  Seed: DILNNFPHSI (KKLC1_HUMAN)
DILNNFPHSV

SEQ ID NO: 39119 - protein, 10 aa, Artificial Sequence
  Description of Artificial Sequence: Synthetic peptide
  Seed: ILNNFPHSIA (KKLC1_HUMAN)
IMNNFPHSIL

SEQ ID NO: 39120 - protein, 9 aa, Artificial Sequence
  Description of Artificial Sequence: Synthetic peptide
  Seed: MVENKLVEL (KKLC1_HUMAN)
MTENKLVEF

SEQ ID NO: 39121 - protein, 9 aa, Artificial Sequence
  Description of Artificial Sequence: Synthetic peptide
  Seed: KGFRGASPH (KKLC1_HUMAN)
KMFRGASPM

SEQ ID NO: 39122 - protein, 9 aa, Artificial Sequence
  Description of Artificial Sequence: Synthetic peptide
  Seed: KYRRFQRNT (KKLC1_HUMAN)
KSRRFQRNI

SEQ ID NO: 39123 - protein, 9 aa, Artificial Sequence
  Description of Artificial Sequence: Synthetic peptide
  Seed: HSIARQKRI (KKLC1_HUMAN)
HTIARQKRF

SEQ ID NO: 39124 - protein, 9 aa, Artificial Sequence
  Description of Artificial Sequence: Synthetic peptide
  Seed: KYRRFQRNT (KKLC1_HUMAN)
KVRRFQRNA

SEQ ID NO: 39125 - protein, 8 aa, Artificial Sequence
  Description of Artificial Sequence: Synthetic peptide
  Seed: VYDLSRDI (KKLC1_HUMAN)
VFDLSRDI

SEQ ID NO: 39126 - protein, 9 aa, Artificial Sequence
  Description of Artificial Sequence: Synthetic peptide
  Seed: VYDLSRDIL (KKLC1_HUMAN)
VGDLSRDIM

SEQ ID NO: 39127 - protein, 11 aa, Artificial Sequence
  Description of Artificial Sequence: Synthetic peptide
  Seed: RDILNNFPHSI (KKLC1_HUMAN)
RGILNNFPHSV

SEQ ID NO: 39128 - protein, 9 aa, Artificial Sequence
  Description of Artificial Sequence: Synthetic peptide
  Seed: NTDNNLAVY (KKLC1_HUMAN)
NLDNNLAVV

SEQ ID NO: 39129 - protein, 10 aa, Artificial Sequence
  Description of Artificial Sequence: Synthetic peptide
  Seed: QKRILVNLSM (KKLC1_HUMAN)
QLRILVNLSL

SEQ ID NO: 39130 - protein, 10 aa, Artificial Sequence
  Description of Artificial Sequence: Synthetic peptide
  Seed: SSNSTALALV (KKLC1_HUMAN)
SINSTALALV

SEQ ID NO: 39131 - protein, 9 aa, Artificial Sequence
  Description of Artificial Sequence: Synthetic peptide
  Seed: ASSILCALI (KKLC1_HUMAN)
ALSILCALV

SEQ ID NO: 39132 - protein, 10 aa, Artificial Sequence
  Description of Artificial Sequence: Synthetic peptide
  Seed: FYLLLASSIL (KKLC1_HUMAN)
FLLLLASSIL

SEQ ID NO: 39133 - protein, 9 aa, Artificial Sequence
  Description of Artificial Sequence: Synthetic peptide
  Seed: KRILVNLSM (KKLC1_HUMAN)
KHILVNLSY

SEQ ID NO: 39134 - protein, 10 aa, Artificial Sequence
  Description of Artificial Sequence: Synthetic peptide
  Seed: KGFRGASPHR (KKLC1_HUMAN)
KKFRGASPHA

SEQ ID NO: 39135 - protein, 9 aa, Artificial Sequence
  Description of Artificial Sequence: Synthetic peptide
  Seed: ILNNFPHSI (KKLC1_HUMAN)
IYNNFPHSL

SEQ ID NO: 39136 - protein, 9 aa, Artificial Sequence
  Description of Artificial Sequence: Synthetic peptide
  Seed: SNTDNNLAV (KKLC1_HUMAN)
SSTDNNLAI

SEQ ID NO: 39137 - protein, 9 aa, Artificial Sequence
  Description of Artificial Sequence: Synthetic peptide
  Seed: SSNSTALAL (KKLC1_HUMAN)
STNSTALAL

SEQ ID NO: 39138 - protein, 10 aa, Artificial Sequence
  Description of Artificial Sequence: Synthetic peptide
  Seed: KGFRGASPHR (KKLC1_HUMAN)
KTFRGASPHR

SEQ ID NO: 39139 - protein, 11 aa, Artificial Sequence
  Description of Artificial Sequence: Synthetic peptide
  Seed: RDILNNFPHSI (KKLC1_HUMAN)
RMILNNFPHSV

SEQ ID NO: 39140 - protein, 9 aa, Artificial Sequence
  Description of Artificial Sequence: Synthetic peptide
  Seed: KLVELEHTL (KKLC1_HUMAN)
KTVELEHTW

SEQ ID NO: 39141 - protein, 9 aa, Artificial Sequence
  Description of Artificial Sequence: Synthetic peptide
  Seed: LASSILCAL (KKLC1_HUMAN)
LLSSILCAM

SEQ ID NO: 39142 - protein, 10 aa, Artificial Sequence
  Description of Artificial Sequence: Synthetic peptide
  Seed: LASSILCALI (KKLC1_HUMAN)
LLSSILCALY

SEQ ID NO: 39143 - protein, 9 aa, Artificial Sequence
  Description of Artificial Sequence: Synthetic peptide
  Seed: KRILVNLSM (KKLC1_HUMAN)
KVILVNLSF

SEQ ID NO: 39144 - protein, 9 aa, Artificial Sequence
  Description of Artificial Sequence: Synthetic peptide
  Seed: KLVELEHTL (KKLC1_HUMAN)
KEVELEHTM

SEQ ID NO: 39145 - protein, 11 aa, Artificial Sequence
  Description of Artificial Sequence: Synthetic peptide
  Seed: KGFRGASPHRK (KKLC1_HUMAN)
KVFRGASPHRK

SEQ ID NO: 39146 - protein, 9 aa, Artificial Sequence
  Description of Artificial Sequence: Synthetic peptide
  Seed: NLAVYDLSR (KKLC1_HUMAN)
NIAVYDLSK

SEQ ID NO: 39147 - protein, 9 aa, Artificial Sequence
  Description of Artificial Sequence: Synthetic peptide
  Seed: AVYDLSRDI (KKLC1_HUMAN)
AMYDLSRDI

SEQ ID NO: 39148 - protein, 10 aa, Artificial Sequence
  Description of Artificial Sequence: Synthetic peptide
  Seed: CALIVFWKYR (KKLC1_HUMAN)
CYLIVFWKYK

SEQ ID NO: 39149 - protein, 9 aa, Artificial Sequence
  Description of Artificial Sequence: Synthetic peptide
  Seed: GEMSSNSTA (KKLC1_HUMAN)
GEMSSNSTM

SEQ ID NO: 39150 - protein, 9 aa, Artificial Sequence
  Description of Artificial Sequence: Synthetic peptide
  Seed: SSNSTALAL (KKLC1_HUMAN)
SWNSTALAL

SEQ ID NO: 39151 - protein, 9 aa, Artificial Sequence
  Description of Artificial Sequence: Synthetic peptide
  Seed: KLVELEHTL (KKLC1_HUMAN)
KQVELEHTM

SEQ ID NO: 39152 - protein, 10 aa, Artificial Sequence
  Description of Artificial Sequence: Synthetic peptide
  Seed: MSSNSTALAL (KKLC1_HUMAN)
MQSNSTALAI

SEQ ID NO: 39153 - protein, 10 aa, Artificial Sequence
  Description of Artificial Sequence: Synthetic peptide
  Seed: SKGFRGASPH (KKLC1_HUMAN)
SRGFRGASPF

SEQ ID NO: 39154 - protein, 9 aa, Artificial Sequence
  Description of Artificial Sequence: Synthetic peptide
  Seed: HTLLSKGFR (KKLC1_HUMAN)
HMLLSKGFR

SEQ ID NO: 39155 - protein, 9 aa, Artificial Sequence
  Description of Artificial Sequence: Synthetic peptide
  Seed: MSSNSTALA (KKLC1_HUMAN)
MVSNSTALM

SEQ ID NO: 39156 - protein, 9 aa, Artificial Sequence
  Description of Artificial Sequence: Synthetic peptide
  Seed: RQKRILVNL (KKLC1_HUMAN)
REKRILVNI

SEQ ID NO: 39157 - protein, 10 aa, Artificial Sequence
  Description of Artificial Sequence: Synthetic peptide
  Seed: RQKRILVNLS (KKLC1_HUMAN)
RSKRILVNLA

SEQ ID NO: 39158 - protein, 9 aa, Artificial Sequence
  Description of Artificial Sequence: Synthetic peptide
  Seed: ILNNFPHSI (KKLC1_HUMAN)
ITNNFPHSR

SEQ ID NO: 39159 - protein, 9 aa, Artificial Sequence
  Description of Artificial Sequence: Synthetic peptide
  Seed: RQKRILVNL (KKLC1_HUMAN)
RLKRILVNV

SEQ ID NO: 39160 - protein, 10 aa, Artificial Sequence
  Description of Artificial Sequence: Synthetic peptide
  Seed: RQKRILVNLS (KKLC1_HUMAN)
RTKRILVNLT

SEQ ID NO: 39161 - protein, 9 aa, Artificial Sequence
  Description of Artificial Sequence: Synthetic peptide
  Seed: KLVELEHTL (KKLC1_HUMAN)
KFVELEHTY

SEQ ID NO: 39162 - protein, 9 aa, Artificial Sequence
  Description of Artificial Sequence: Synthetic peptide
  Seed: MSSNSTALA (KKLC1_HUMAN)
MVSNSTALA

SEQ ID NO: 39163 - protein, 9 aa, Artificial Sequence
  Description of Artificial Sequence: Synthetic peptide
  Seed: LASSILCAL (KKLC1_HUMAN)
LQSSILCAI

SEQ ID NO: 39164 - protein, 9 aa, Artificial Sequence
  Description of Artificial Sequence: Synthetic peptide
  Seed: CALIVFWKY (KKLC1_HUMAN)
CFLIVFWKY

SEQ ID NO: 39165 - protein, 10 aa, Artificial Sequence
  Description of Artificial Sequence: Synthetic peptide
  Seed: VFWKYRRFQR (KKLC1_HUMAN)
VWWKYRRFQR

SEQ ID NO: 39166 - protein, 9 aa, Artificial Sequence
  Description of Artificial Sequence: Synthetic peptide
  Seed: YLLLASSIL (KKLC1_HUMAN)
YVLLASSIY

SEQ ID NO: 39167 - protein, 9 aa, Artificial Sequence
  Description of Artificial Sequence: Synthetic peptide
  Seed: LASSILCAL (KKLC1_HUMAN)
LQSSILCAF

SEQ ID NO: 39168 - protein, 9 aa, Artificial Sequence
  Description of Artificial Sequence: Synthetic peptide
  Seed: ELEHTLLSK (KKLC1_HUMAN)
ETEHTLLSK

SEQ ID NO: 39169 - protein, 9 aa, Artificial Sequence
  Description of Artificial Sequence: Synthetic peptide
  Seed: SSNSTALAL (KKLC1_HUMAN)
SLNSTALAI

SEQ ID NO: 39170 - protein, 11 aa, Artificial Sequence
  Description of Artificial Sequence: Synthetic peptide
  Seed: RDILNNFPHSI (KKLC1_HUMAN)
RKILNNFPHSV

SEQ ID NO: 39171 - protein, 9 aa, Artificial Sequence
  Description of Artificial Sequence: Synthetic peptide
  Seed: CALIVFWKY (KKLC1_HUMAN)
CMLIVFWKY

SEQ ID NO: 39172 - protein, 9 aa, Artificial Sequence
  Description of Artificial Sequence: Synthetic peptide
  Seed: YLLLASSIL (KKLC1_HUMAN)
YPLLASSIM

SEQ ID NO: 39173 - protein, 10 aa, Artificial Sequence
  Description of Artificial Sequence: Synthetic peptide
  Seed: LASSILCALI (KKLC1_HUMAN)
LMSSILCALE

SEQ ID NO: 39174 - protein, 9 aa, Artificial Sequence
  Description of Artificial Sequence: Synthetic peptide
  Seed: SSNSTALAL (KKLC1_HUMAN)
SFNSTALAI

SEQ ID NO: 39175 - protein, 9 aa, Artificial Sequence
  Description of Artificial Sequence: Synthetic peptide
  Seed: EMSSNSTAL (KKLC1_HUMAN)
ELSSNSTAY

SEQ ID NO: 39176 - protein, 9 aa, Artificial Sequence
  Description of Artificial Sequence: Synthetic peptide
  Seed: RQKRILVNL (KKLC1_HUMAN)
RFKRILVNS

SEQ ID NO: 39177 - protein, 10 aa, Artificial Sequence
  Description of Artificial Sequence: Synthetic peptide
  Seed: RQKRILVNLS (KKLC1_HUMAN)
RVKRILVNLA

SEQ ID NO: 39178 - protein, 10 aa, Artificial Sequence
  Description of Artificial Sequence: Synthetic peptide
  Seed: KLVELEHTLL (KKLC1_HUMAN)
KIVELEHTLR

SEQ ID NO: 39179 - protein, 10 aa, Artificial Sequence
  Description of Artificial Sequence: Synthetic peptide
  Seed: RRFQRNTGEM (KKLC1_HUMAN)
RLFQRNTGEY

SEQ ID NO: 39180 - protein, 9 aa, Artificial Sequence
  Description of Artificial Sequence: Synthetic peptide
  Seed: RQKRILVNL (KKLC1_HUMAN)
RRKRILVNI

SEQ ID NO: 39181 - protein, 9 aa, Artificial Sequence
  Description of Artificial Sequence: Synthetic peptide
  Seed: LASSILCAL (KKLC1_HUMAN)
LMSSILCAM

SEQ ID NO: 39182 - protein, 9 aa, Artificial Sequence
  Description of Artificial Sequence: Synthetic peptide
  Seed: NNFPHSIAR (KKLC1_HUMAN)
NIFPHSIAM

SEQ ID NO: 39183 - protein, 9 aa, Artificial Sequence
  Description of Artificial Sequence: Synthetic peptide
  Seed: ILNNFPHSI (KKLC1_HUMAN)
IVNNFPHSV

SEQ ID NO: 39184 - protein, 9 aa, Artificial Sequence
  Description of Artificial Sequence: Synthetic peptide
  Seed: LASSILCAL (KKLC1_HUMAN)
LPSSILCAW

SEQ ID NO: 39185 - protein, 9 aa, Artificial Sequence
  Description of Artificial Sequence: Synthetic peptide
  Seed: ASSILCALI (KKLC1_HUMAN)
ATSILCALW

SEQ ID NO: 39186 - protein, 9 aa, Artificial Sequence
  Description of Artificial Sequence: Synthetic peptide
  Seed: LASSILCAL (KKLC1_HUMAN)
LTSSILCAM

SEQ ID NO: 39187 - protein, 10 aa, Artificial Sequence
  Description of Artificial Sequence: Synthetic peptide
  Seed: DILNNFPHSI (KKLC1_HUMAN)
DRLNNFPHSV

SEQ ID NO: 39188 - protein, 10 aa, Artificial Sequence
  Description of Artificial Sequence: Synthetic peptide
  Seed: SSNSTALALV (KKLC1_HUMAN)
SLNSTALALI

SEQ ID NO: 39189 - protein, 9 aa, Artificial Sequence
  Description of Artificial Sequence: Synthetic peptide
  Seed: CALIVFWKY (KKLC1_HUMAN)
CTLIVFWKY

SEQ ID NO: 39190 - protein, 10 aa, Artificial Sequence
  Description of Artificial Sequence: Synthetic peptide
  Seed: NFYLLLASSI (KKLC1_HUMAN)
NKYLLLASSF

SEQ ID NO: 39191 - protein, 9 aa, Artificial Sequence
  Description of Artificial Sequence: Synthetic peptide
  Seed: LSRDILNNF (KKLC1_HUMAN)
LRRDILNNY

SEQ ID NO: 39192 - protein, 9 aa, Artificial Sequence
  Description of Artificial Sequence: Synthetic peptide
  Seed: KGFRGASPH (KKLC1_HUMAN)
KNFRGASPF

SEQ ID NO: 39193 - protein, 10 aa, Artificial Sequence
  Description of Artificial Sequence: Synthetic peptide
  Seed: MSSNSTALAL (KKLC1_HUMAN)
MSSNSTALAW

SEQ ID NO: 39194 - protein, 11 aa, Artificial Sequence
  Description of Artificial Sequence: Synthetic peptide
  Seed: RQKRILVNLSM (KKLC1_HUMAN)
RAKRILVNLSK

SEQ ID NO: 39195 - protein, 9 aa, Artificial Sequence
  Description of Artificial Sequence: Synthetic peptide
  Seed: AVYDLSRDI (KKLC1_HUMAN)
AQYDLSRDL

SEQ ID NO: 39196 - protein, 9 aa, Artificial Sequence
  Description of Artificial Sequence: Synthetic peptide
  Seed: IARQKRILV (KKLC1_HUMAN)
ITRQKRILV

SEQ ID NO: 39197 - protein, 9 aa, Artificial Sequence
  Description of Artificial Sequence: Synthetic peptide
  Seed: LVELEHTLL (KKLC1_HUMAN)
LYELEHTLM

SEQ ID NO: 39198 - protein, 8 aa, Artificial Sequence
  Description of Artificial Sequence: Synthetic peptide
  Seed: VYDLSRDI (KKLC1_HUMAN)
VLDLSRDL

SEQ ID NO: 39199 - protein, 11 aa, Artificial Sequence
  Description of Artificial Sequence: Synthetic peptide
  Seed: RQKRILVNLSM (KKLC1_HUMAN)
RCKRILVNLSV

SEQ ID NO: 39200 - protein, 9 aa, Artificial Sequence
  Description of Artificial Sequence: Synthetic peptide
  Seed: KLVELEHTL (KKLC1_HUMAN)
KQVELEHTF

SEQ ID NO: 39201 - protein, 10 aa, Artificial Sequence
  Description of Artificial Sequence: Synthetic peptide
  Seed: ILCALIVFWK (KKLC1_HUMAN)
ILCALIVFWR

SEQ ID NO: 39202 - protein, 10 aa, Artificial Sequence
  Description of Artificial Sequence: Synthetic peptide
  Seed: LLLASSILCA (KKLC1_HUMAN)
LGLASSILCV

SEQ ID NO: 39203 - protein, 9 aa, Artificial Sequence
  Description of Artificial Sequence: Synthetic peptide
  Seed: RQKRILVNL (KKLC1_HUMAN)
RTKRILVNP

SEQ ID NO: 39204 - protein, 11 aa, Artificial Sequence
  Description of Artificial Sequence: Synthetic peptide
  Seed: RDILNNFPHSI (KKLC1_HUMAN)
RYILNNFPHSV

SEQ ID NO: 39205 - protein, 10 aa, Artificial Sequence
  Description of Artificial Sequence: Synthetic peptide
  Seed: KRILVNLSMV (KKLC1_HUMAN)
KRILVNLSMK

SEQ ID NO: 39206 - protein, 9 aa, Artificial Sequence
  Description of Artificial Sequence: Synthetic peptide
  Seed: NSTALALVR (KKLC1_HUMAN)
NFTALALVR

SEQ ID NO: 39207 - protein, 9 aa, Artificial Sequence
  Description of Artificial Sequence: Synthetic peptide
  Seed: SNTDNNLAV (KKLC1_HUMAN)
SQTDNNLAL

SEQ ID NO: 39208 - protein, 10 aa, Artificial Sequence
  Description of Artificial Sequence: Synthetic peptide
  Seed: ALVRPSSSGL (KKLC1_HUMAN)
AFVRPSSSGK

SEQ ID NO: 39209 - protein, 9 aa, Artificial Sequence
  Description of Artificial Sequence: Synthetic peptide
  Seed: KYRRFQRNT (KKLC1_HUMAN)
KFRRFQRNI

SEQ ID NO: 39210 - protein, 9 aa, Artificial Sequence
  Description of Artificial Sequence: Synthetic peptide
  Seed: SSNSTALAL (KKLC1_HUMAN)
SGNSTALAF

SEQ ID NO: 39211 - protein, 10 aa, Artificial Sequence
  Description of Artificial Sequence: Synthetic peptide
  Seed: NFYLLLASSI (KKLC1_HUMAN)
NYYLLLASSW

SEQ ID NO: 39212 - protein, 9 aa, Artificial Sequence
  Description of Artificial Sequence: Synthetic peptide
  Seed: RQKRILVNL (KKLC1_HUMAN)
RTKRILVNR

SEQ ID NO: 39213 - protein, 9 aa, Artificial Sequence
  Description of Artificial Sequence: Synthetic peptide
  Seed: SNTDNNLAV (KKLC1_HUMAN)
SVTDNNLAL

SEQ ID NO: 39214 - protein, 10 aa, Artificial Sequence
  Description of Artificial Sequence: Synthetic peptide
  Seed: LLASSILCAL (KKLC1_HUMAN)
LMASSILCAT

SEQ ID NO: 39215 - protein, 9 aa, Artificial Sequence
  Description of Artificial Sequence: Synthetic peptide
  Seed: MSSNSTALA (KKLC1_HUMAN)
MMSNSTALL

SEQ ID NO: 39216 - protein, 10 aa, Artificial Sequence
  Description of Artificial Sequence: Synthetic peptide
  Seed: QKRILVNLSM (KKLC1_HUMAN)
QIRILVNLSV

SEQ ID NO: 39217 - protein, 11 aa, Artificial Sequence
  Description of Artificial Sequence: Synthetic peptide
  Seed: KGFRGASPHRK (KKLC1_HUMAN)
KAFRGASPHRR

SEQ ID NO: 39218 - protein, 9 aa, Artificial Sequence
  Description of Artificial Sequence: Synthetic peptide
  Seed: KYRRFQRNT (KKLC1_HUMAN)
KVRRFQRNF

SEQ ID NO: 39219 - protein, 11 aa, Artificial Sequence
  Description of Artificial Sequence: Synthetic peptide
  Seed: LSMVENKLVEL (KKLC1_HUMAN)
LMMVENKLVEI

SEQ ID NO: 39220 - protein, 10 aa, Artificial Sequence
  Description of Artificial Sequence: Synthetic peptide
  Seed: VNLSMVENKL (KKLC1_HUMAN)
VYLSMVENKV

SEQ ID NO: 39221 - protein, 9 aa, Artificial Sequence
  Description of Artificial Sequence: Synthetic peptide
  Seed: KYRRFQRNT (KKLC1_HUMAN)
KMRRFQRNV

SEQ ID NO: 39222 - protein, 9 aa, Artificial Sequence
  Description of Artificial Sequence: Synthetic peptide
  Seed: KGFRGASPH (KKLC1_HUMAN)
KVFRGASPY

SEQ ID NO: 39223 - protein, 9 aa, Artificial Sequence
  Description of Artificial Sequence: Synthetic peptide
  Seed: KLVELEHTL (KKLC1_HUMAN)
KRVELEHTY

SEQ ID NO: 39224 - protein, 9 aa, Artificial Sequence
  Description of Artificial Sequence: Synthetic peptide
  Seed: LEHTLLSKG (KKLC1_HUMAN)
LEHTLLSKA

SEQ ID NO: 39225 - protein, 9 aa, Artificial Sequence
  Description of Artificial Sequence: Synthetic peptide
  Seed: NTDNNLAVY (KKLC1_HUMAN)
NVDNNLAVM

SEQ ID NO: 39226 - protein, 9 aa, Artificial Sequence
  Description of Artificial Sequence: Synthetic peptide
  Seed: LSRDILNNF (KKLC1_HUMAN)
LRRDILNNL

SEQ ID NO: 39227 - protein, 9 aa, Artificial Sequence
  Description of Artificial Sequence: Synthetic peptide
  Seed: KLVELEHTL (KKLC1_HUMAN)
KMVELEHTV

SEQ ID NO: 39228 - protein, 11 aa, Artificial Sequence
  Description of Artificial Sequence: Synthetic peptide
  Seed: RDILNNFPHSI (KKLC1_HUMAN)
RTILNNFPHSV

SEQ ID NO: 39229 - protein, 10 aa, Artificial Sequence
  Description of Artificial Sequence: Synthetic peptide
  Seed: VELEHTLLSK (KKLC1_HUMAN)
VALEHTLLSL

SEQ ID NO: 39230 - protein, 9 aa, Artificial Sequence
  Description of Artificial Sequence: Synthetic peptide
  Seed: GFRGASPHR (KKLC1_HUMAN)
GMRGASPHK

SEQ ID NO: 39231 - protein, 10 aa, Artificial Sequence
  Description of Artificial Sequence: Synthetic peptide
  Seed: KYRRFQRNTG (KKLC1_HUMAN)
KTRRFQRNTM

SEQ ID NO: 39232 - protein, 10 aa, Artificial Sequence
  Description of Artificial Sequence: Synthetic peptide
  Seed: RQKRILVNLS (KKLC1_HUMAN)
RAKRILVNLA

SEQ ID NO: 39233 - protein, 11 aa, Artificial Sequence
  Description of Artificial Sequence: Synthetic peptide
  Seed: MNFYLLLASSI (KKLC1_HUMAN)
MPFYLLLASSF

SEQ ID NO: 39234 - protein, 9 aa, Artificial Sequence
  Description of Artificial Sequence: Synthetic peptide
  Seed: KLVELEHTL (KKLC1_HUMAN)
KLVELEHTV

SEQ ID NO: 39235 - protein, 10 aa, Artificial Sequence
  Description of Artificial Sequence: Synthetic peptide
  Seed: EMSSNSTALA (KKLC1_HUMAN)
ELSSNSTALV

SEQ ID NO: 39236 - protein, 9 aa, Artificial Sequence
  Description of Artificial Sequence: Synthetic peptide
  Seed: ELEHTLLSK (KKLC1_HUMAN)
ESEHTLLSY

SEQ ID NO: 39237 - protein, 8 aa, Artificial Sequence
  Description of Artificial Sequence: Synthetic peptide
  Seed: VYDLSRDI (KKLC1_HUMAN)
VVDLSRDV

SEQ ID NO: 39238 - protein, 9 aa, Artificial Sequence
  Description of Artificial Sequence: Synthetic peptide
  Seed: SSNSTALAL (KKLC1_HUMAN)
SFNSTALAY

SEQ ID NO: 39239 - protein, 10 aa, Artificial Sequence
  Description of Artificial Sequence: Synthetic peptide
  Seed: GEMSSNSTAL (KKLC1_HUMAN)
GMMSSNSTAI

SEQ ID NO: 39240 - protein, 10 aa, Artificial Sequence
  Description of Artificial Sequence: Synthetic peptide
  Seed: KGFRGASPHR (KKLC1_HUMAN)
KLFRGASPHR

SEQ ID NO: 39241 - protein, 9 aa, Artificial Sequence
  Description of Artificial Sequence: Synthetic peptide
  Seed: LASSILCAL (KKLC1_HUMAN)
LTSSILCAY

SEQ ID NO: 39242 - protein, 9 aa, Artificial Sequence
  Description of Artificial Sequence: Synthetic peptide
  Seed: VYDLSRDIL (KKLC1_HUMAN)
VADLSRDIM

SEQ ID NO: 39243 - protein, 9 aa, Artificial Sequence
  Description of Artificial Sequence: Synthetic peptide
  Seed: NNFPHSIAR (KKLC1_HUMAN)
NTFPHSIAF

SEQ ID NO: 39244 - protein, 9 aa, Artificial Sequence
  Description of Artificial Sequence: Synthetic peptide
  Seed: KLVELEHTL (KKLC1_HUMAN)
KRVELEHTL

SEQ ID NO: 39245 - protein, 10 aa, Artificial Sequence
  Description of Artificial Sequence: Synthetic peptide
  Seed: KLVELEHTLL (KKLC1_HUMAN)
KTVELEHTLF

SEQ ID NO: 39246 - protein, 10 aa, Artificial Sequence
  Description of Artificial Sequence: Synthetic peptide
  Seed: NFYLLLASSI (KKLC1_HUMAN)
NSYLLLASSF

SEQ ID NO: 39247 - protein, 10 aa, Artificial Sequence
  Description of Artificial Sequence: Synthetic peptide
  Seed: KGFRGASPHR (KKLC1_HUMAN)
KMFRGASPHI

SEQ ID NO: 39248 - protein, 9 aa, Artificial Sequence
  Description of Artificial Sequence: Synthetic peptide
  Seed: LSRDILNNF (KKLC1_HUMAN)
LARDILNNI

SEQ ID NO: 39249 - protein, 10 aa, Artificial Sequence
  Description of Artificial Sequence: Synthetic peptide
  Seed: ALIVFWKYRR (KKLC1_HUMAN)
AYIVFWKYRR

SEQ ID NO: 39250 - protein, 9 aa, Artificial Sequence
  Description of Artificial Sequence: Synthetic peptide
  Seed: YLLLASSIL (KKLC1_HUMAN)
YPLLASSIV

SEQ ID NO: 39251 - protein, 11 aa, Artificial Sequence
  Description of Artificial Sequence: Synthetic peptide
  Seed: MNFYLLLASSI (KKLC1_HUMAN)
MRFYLLLASSF

SEQ ID NO: 39252 - protein, 9 aa, Artificial Sequence
  Description of Artificial Sequence: Synthetic peptide
  Seed: ALIVFWKYR (KKLC1_HUMAN)
AVIVFWKYR

SEQ ID NO: 39253 - protein, 10 aa, Artificial Sequence
  Description of Artificial Sequence: Synthetic peptide
  Seed: MSSNSTALAL (KKLC1_HUMAN)
MCSNSTALAF

SEQ ID NO: 39254 - protein, 9 aa, Artificial Sequence
  Description of Artificial Sequence: Synthetic peptide
  Seed: MVENKLVEL (KKLC1_HUMAN)
MMENKLVEA

SEQ ID NO: 39255 - protein, 9 aa, Artificial Sequence
  Description of Artificial Sequence: Synthetic peptide
  Seed: MSSNSTALA (KKLC1_HUMAN)
MASNSTALI

SEQ ID NO: 39256 - protein, 9 aa, Artificial Sequence
  Description of Artificial Sequence: Synthetic peptide
  Seed: MSSNSTALA (KKLC1_HUMAN)
MVSNSTALI

SEQ ID NO: 39257 - protein, 9 aa, Artificial Sequence
  Description of Artificial Sequence: Synthetic peptide
  Seed: KGFRGASPH (KKLC1_HUMAN)
KQFRGASPI

SEQ ID NO: 39258 - protein, 9 aa, Artificial Sequence
  Description of Artificial Sequence: Synthetic peptide
  Seed: LVRPSSSGL (KKLC1_HUMAN)
LMRPSSSGF

SEQ ID NO: 39259 - protein, 9 aa, Artificial Sequence
  Description of Artificial Sequence: Synthetic peptide
  Seed: KLVELEHTL (KKLC1_HUMAN)
KCVELEHTF

SEQ ID NO: 39260 - protein, 10 aa, Artificial Sequence
  Description of Artificial Sequence: Synthetic peptide
  Seed: SNSTALALVR (KKLC1_HUMAN)
SMSTALALVR

SEQ ID NO: 39261 - protein, 9 aa, Artificial Sequence
  Description of Artificial Sequence: Synthetic peptide
  Seed: FWKYRRFQR (KKLC1_HUMAN)
FQKYRRFQR

SEQ ID NO: 39262 - protein, 9 aa, Artificial Sequence
  Description of Artificial Sequence: Synthetic peptide
  Seed: ILNNFPHSI (KKLC1_HUMAN)
IFNNFPHSV

SEQ ID NO: 39263 - protein, 11 aa, Artificial Sequence
  Description of Artificial Sequence: Synthetic peptide
  Seed: RQKRILVNLSM (KKLC1_HUMAN)
RCKRILVNLSK

SEQ ID NO: 39264 - protein, 10 aa, Artificial Sequence
  Description of Artificial Sequence: Synthetic peptide
  Seed: KYRRFQRNTG (KKLC1_HUMAN)
KTRRFQRNTS

SEQ ID NO: 39265 - protein, 9 aa, Artificial Sequence
  Description of Artificial Sequence: Synthetic peptide
  Seed: ILNNFPHSI (KKLC1_HUMAN)
IHNNFPHSF

SEQ ID NO: 39266 - protein, 11 aa, Artificial Sequence
  Description of Artificial Sequence: Synthetic peptide
  Seed: NNFPHSIARQK (KKLC1_HUMAN)
NFFPHSIARQR

SEQ ID NO: 39267 - protein, 10 aa, Artificial Sequence
  Description of Artificial Sequence: Synthetic peptide
  Seed: ILNNFPHSIA (KKLC1_HUMAN)
ILNNFPHSIL

SEQ ID NO: 39268 - protein, 11 aa, Artificial Sequence
  Description of Artificial Sequence: Synthetic peptide
  Seed: RQKRILVNLSM (KKLC1_HUMAN)
RWKRILVNLSL

SEQ ID NO: 39269 - protein, 10 aa, Artificial Sequence
  Description of Artificial Sequence: Synthetic peptide
  Seed: NKLVELEHTL (KKLC1_HUMAN)
NFLVELEHTV

SEQ ID NO: 39270 - protein, 10 aa, Artificial Sequence
  Description of Artificial Sequence: Synthetic peptide
  Seed: LLLASSILCA (KKLC1_HUMAN)
LDLASSILCV

SEQ ID NO: 39271 - protein, 11 aa, Artificial Sequence
  Description of Artificial Sequence: Synthetic peptide
  Seed: IVFWKYRRFQR (KKLC1_HUMAN)
IYFWKYRRFQK

SEQ ID NO: 39272 - protein, 10 aa, Artificial Sequence
  Description of Artificial Sequence: Synthetic peptide
  Seed: SMVENKLVEL (KKLC1_HUMAN)
STVENKLVEF

SEQ ID NO: 39273 - protein, 9 aa, Artificial Sequence
  Description of Artificial Sequence: Synthetic peptide
  Seed: KLVELEHTL (KKLC1_HUMAN)
KSVELEHTY

SEQ ID NO: 39274 - protein, 9 aa, Artificial Sequence
  Description of Artificial Sequence: Synthetic peptide
  Seed: RILVNLSMV (KKLC1_HUMAN)
RILVNLSMW

SEQ ID NO: 39275 - protein, 10 aa, Artificial Sequence
  Description of Artificial Sequence: Synthetic peptide
  Seed: YLLLASSILC (KKLC1_HUMAN)
YMLLASSILA

SEQ ID NO: 39276 - protein, 9 aa, Artificial Sequence
  Description of Artificial Sequence: Synthetic peptide
  Seed: KLVELEHTL (KKLC1_HUMAN)
KLVELEHTR

SEQ ID NO: 39277 - protein, 10 aa, Artificial Sequence
  Description of Artificial Sequence: Synthetic peptide
  Seed: EMSSNSTALA (KKLC1_HUMAN)
EKSSNSTALV

SEQ ID NO: 39278 - protein, 10 aa, Artificial Sequence
  Description of Artificial Sequence: Synthetic peptide
  Seed: MSSNSTALAL (KKLC1_HUMAN)
MPSNSTALAW

SEQ ID NO: 39279 - protein, 10 aa, Artificial Sequence
  Description of Artificial Sequence: Synthetic peptide
  Seed: SNSTALALVR (KKLC1_HUMAN)
SASTALALVR

SEQ ID NO: 39280 - protein, 9 aa, Artificial Sequence
  Description of Artificial Sequence: Synthetic peptide
  Seed: LVRPSSSGL (KKLC1_HUMAN)
LTRPSSSGI

SEQ ID NO: 39281 - protein, 10 aa, Artificial Sequence
  Description of Artificial Sequence: Synthetic peptide
  Seed: YLLLASSILC (KKLC1_HUMAN)
YVLLASSILL

SEQ ID NO: 39282 - protein, 9 aa, Artificial Sequence
  Description of Artificial Sequence: Synthetic peptide
  Seed: KGFRGASPH (KKLC1_HUMAN)
KMFRGASPY

SEQ ID NO: 39283 - protein, 10 aa, Artificial Sequence
  Description of Artificial Sequence: Synthetic peptide
  Seed: LASSILCALI (KKLC1_HUMAN)
LMSSILCALG

SEQ ID NO: 39284 - protein, 9 aa, Artificial Sequence
  Description of Artificial Sequence: Synthetic peptide
  Seed: LSRDILNNF (KKLC1_HUMAN)
LPRDILNNY

SEQ ID NO: 39285 - protein, 10 aa, Artificial Sequence
  Description of Artificial Sequence: Synthetic peptide
  Seed: FYLLLASSIL (KKLC1_HUMAN)
FQLLLASSIV

SEQ ID NO: 39286 - protein, 10 aa, Artificial Sequence
  Description of Artificial Sequence: Synthetic peptide
  Seed: FYLLLASSIL (KKLC1_HUMAN)
FALLLASSIV

SEQ ID NO: 39287 - protein, 9 aa, Artificial Sequence
  Description of Artificial Sequence: Synthetic peptide
  Seed: NNFPHSIAR (KKLC1_HUMAN)
NGFPHSIAR

SEQ ID NO: 39288 - protein, 9 aa, Artificial Sequence
  Description of Artificial Sequence: Synthetic peptide
  Seed: NLAVYDLSR (KKLC1_HUMAN)
NIAVYDLSR

SEQ ID NO: 39289 - protein, 10 aa, Artificial Sequence
  Description of Artificial Sequence: Synthetic peptide
  Seed: KGFRGASPHR (KKLC1_HUMAN)
KIFRGASPHV

SEQ ID NO: 39290 - protein, 10 aa, Artificial Sequence
  Description of Artificial Sequence: Synthetic peptide
  Seed: AVYDLSRDIL (KKLC1_HUMAN)
AQYDLSRDIW

SEQ ID NO: 39291 - protein, 9 aa, Artificial Sequence
  Description of Artificial Sequence: Synthetic peptide
  Seed: NTDNNLAVY (KKLC1_HUMAN)
NADNNLAVV

SEQ ID NO: 39292 - protein, 9 aa, Artificial Sequence
  Description of Artificial Sequence: Synthetic peptide
  Seed: SILCALIVF (KKLC1_HUMAN)
SMLCALIVF

SEQ ID NO: 39293 - protein, 10 aa, Artificial Sequence
  Description of Artificial Sequence: Synthetic peptide
  Seed: EMSSNSTALA (KKLC1_HUMAN)
ENSSNSTALV

SEQ ID NO: 39294 - protein, 9 aa, Artificial Sequence
  Description of Artificial Sequence: Synthetic peptide
  Seed: LLASSILCA (KKLC1_HUMAN)
LLASSILCL

SEQ ID NO: 39295 - protein, 9 aa, Artificial Sequence
  Description of Artificial Sequence: Synthetic peptide
  Seed: RQKRILVNL (KKLC1_HUMAN)
RSKRILVNM

SEQ ID NO: 39296 - protein, 9 aa, Artificial Sequence
  Description of Artificial Sequence: Synthetic peptide
  Seed: LSRDILNNF (KKLC1_HUMAN)
LLRDILNNW

SEQ ID NO: 39297 - protein, 9 aa, Artificial Sequence
  Description of Artificial Sequence: Synthetic peptide
  Seed: MSSNSTALA (KKLC1_HUMAN)
MMSNSTALK

SEQ ID NO: 39298 - protein, 9 aa, Artificial Sequence
  Description of Artificial Sequence: Synthetic peptide
  Seed: LSMVENKLV (KKLC1_HUMAN)
LTMVENKLF

SEQ ID NO: 39299 - protein, 10 aa, Artificial Sequence
  Description of Artificial Sequence: Synthetic peptide
  Seed: GEMSSNSTAL (KKLC1_HUMAN)
GHMSSNSTAY

SEQ ID NO: 39300 - protein, 9 aa, Artificial Sequence
  Description of Artificial Sequence: Synthetic peptide
  Seed: LVRPSSSGL (KKLC1_HUMAN)
LSRPSSSGF

SEQ ID NO: 39301 - protein, 10 aa, Artificial Sequence
  Description of Artificial Sequence: Synthetic peptide
  Seed: EMSSNSTALA (KKLC1_HUMAN)
EMSSNSTALV

SEQ ID NO: 39302 - protein, 9 aa, Artificial Sequence
  Description of Artificial Sequence: Synthetic peptide
  Seed: NTDNNLAVY (KKLC1_HUMAN)
NADNNLAVY

SEQ ID NO: 39303 - protein, 10 aa, Artificial Sequence
  Description of Artificial Sequence: Synthetic peptide
  Seed: VNLSMVENKL (KKLC1_HUMAN)
VYLSMVENKL

SEQ ID NO: 39304 - protein, 10 aa, Artificial Sequence
  Description of Artificial Sequence: Synthetic peptide
  Seed: SMVENKLVEL (KKLC1_HUMAN)
SVVENKLVEY

SEQ ID NO: 39305 - protein, 10 aa, Artificial Sequence
  Description of Artificial Sequence: Synthetic peptide
  Seed: LLASSILCAL (KKLC1_HUMAN)
LAASSILCAY

SEQ ID NO: 39306 - protein, 9 aa, Artificial Sequence
  Description of Artificial Sequence: Synthetic peptide
  Seed: LASSILCAL (KKLC1_HUMAN)
LISSILCAA

SEQ ID NO: 39307 - protein, 9 aa, Artificial Sequence
  Description of Artificial Sequence: Synthetic peptide
  Seed: NTDNNLAVY (KKLC1_HUMAN)
NTDNNLAVI

SEQ ID NO: 39308 - protein, 10 aa, Artificial Sequence
  Description of Artificial Sequence: Synthetic peptide
  Seed: QKRILVNLSM (KKLC1_HUMAN)
QNRILVNLSF

SEQ ID NO: 39309 - protein, 10 aa, Artificial Sequence
  Description of Artificial Sequence: Synthetic peptide
  Seed: MSSNSTALAL (KKLC1_HUMAN)
MFSNSTALAY

SEQ ID NO: 39310 - protein, 9 aa, Artificial Sequence
  Description of Artificial Sequence: Synthetic peptide
  Seed: KYRRFQRNT (KKLC1_HUMAN)
KVRRFQRNM

SEQ ID NO: 39311 - protein, 10 aa, Artificial Sequence
  Description of Artificial Sequence: Synthetic peptide
  Seed: ILNNFPHSIA (KKLC1_HUMAN)
IMNNFPHSII

SEQ ID NO: 39312 - protein, 9 aa, Artificial Sequence
  Description of Artificial Sequence: Synthetic peptide
  Seed: KYRRFQRNT (KKLC1_HUMAN)
KTRRFQRNT

SEQ ID NO: 39313 - protein, 9 aa, Artificial Sequence
  Description of Artificial Sequence: Synthetic peptide
  Seed: KYRRFQRNT (KKLC1_HUMAN)
KLRRFQRNM

SEQ ID NO: 39314 - protein, 11 aa, Artificial Sequence
  Description of Artificial Sequence: Synthetic peptide
  Seed: LSMVENKLVEL (KKLC1_HUMAN)
LLMVENKLVEL

SEQ ID NO: 39315 - protein, 10 aa, Artificial Sequence
  Description of Artificial Sequence: Synthetic peptide
  Seed: LASSILCALI (KKLC1_HUMAN)
LDSSILCALW

SEQ ID NO: 39316 - protein, 10 aa, Artificial Sequence
  Description of Artificial Sequence: Synthetic peptide
  Seed: MSSNSTALAL (KKLC1_HUMAN)
MRSNSTALAM

SEQ ID NO: 39317 - protein, 9 aa, Artificial Sequence
  Description of Artificial Sequence: Synthetic peptide
  Seed: NTDNNLAVY (KKLC1_HUMAN)
NTDNNLAVL

SEQ ID NO: 39318 - protein, 9 aa, Artificial Sequence
  Description of Artificial Sequence: Synthetic peptide
  Seed: NTDNNLAVY (KKLC1_HUMAN)
NVDNNLAVY

SEQ ID NO: 39319 - protein, 9 aa, Artificial Sequence
  Description of Artificial Sequence: Synthetic peptide
  Seed: LSRDILNNF (KKLC1_HUMAN)
LLRDILNNY

SEQ ID NO: 39320 - protein, 11 aa, Artificial Sequence
  Description of Artificial Sequence: Synthetic peptide
  Seed: MSSNSTALALV (KKLC1_HUMAN)
MVSNSTALALW

SEQ ID NO: 39321 - protein, 10 aa, Artificial Sequence
  Description of Artificial Sequence: Synthetic peptide
  Seed: MSSNSTALAL (KKLC1_HUMAN)
MYSNSTALAM

SEQ ID NO: 39322 - protein, 9 aa, Artificial Sequence
  Description of Artificial Sequence: Synthetic peptide
  Seed: KRILVNLSM (KKLC1_HUMAN)
KVILVNLSY

SEQ ID NO: 39323 - protein, 9 aa, Artificial Sequence
  Description of Artificial Sequence: Synthetic peptide
  Seed: KGFRGASPH (KKLC1_HUMAN)
KAFRGASPF

SEQ ID NO: 39324 - protein, 9 aa, Artificial Sequence
  Description of Artificial Sequence: Synthetic peptide
  Seed: ASSILCALI (KKLC1_HUMAN)
AMSILCALM

SEQ ID NO: 39325 - protein, 10 aa, Artificial Sequence
  Description of Artificial Sequence: Synthetic peptide
  Seed: LASSILCALI (KKLC1_HUMAN)
LRSSILCALW

SEQ ID NO: 39326 - protein, 10 aa, Artificial Sequence
  Description of Artificial Sequence: Synthetic peptide
  Seed: NNLAVYDLSR (KKLC1_HUMAN)
NYLAVYDLSR

SEQ ID NO: 39327 - protein, 9 aa, Artificial Sequence
  Description of Artificial Sequence: Synthetic peptide
  Seed: ILNNFPHSI (KKLC1_HUMAN)
IYNNFPHSM

SEQ ID NO: 39328 - protein, 10 aa, Artificial Sequence
  Description of Artificial Sequence: Synthetic peptide
  Seed: SMVENKLVEL (KKLC1_HUMAN)
SLVENKLVEW

SEQ ID NO: 39329 - protein, 10 aa, Artificial Sequence
  Description of Artificial Sequence: Synthetic peptide
  Seed: SNTDNNLAVY (KKLC1_HUMAN)
SMTDNNLAVY

SEQ ID NO: 39330 - protein, 8 aa, Artificial Sequence
  Description of Artificial Sequence: Synthetic peptide
  Seed: NTDNNLAV (KKLC1_HUMAN)
NWDNNLAF

SEQ ID NO: 39331 - protein, 9 aa, Artificial Sequence
  Description of Artificial Sequence: Synthetic peptide
  Seed: NNFPHSIAR (KKLC1_HUMAN)
NQFPHSIAK

SEQ ID NO: 39332 - protein, 11 aa, Artificial Sequence
  Description of Artificial Sequence: Synthetic peptide
  Seed: MNFYLLLASSI (KKLC1_HUMAN)
MCFYLLLASSF

SEQ ID NO: 39333 - protein, 9 aa, Artificial Sequence
  Description of Artificial Sequence: Synthetic peptide
  Seed: HSIARQKRI (KKLC1_HUMAN)
HAIARQKRW

SEQ ID NO: 39334 - protein, 9 aa, Artificial Sequence
  Description of Artificial Sequence: Synthetic peptide
  Seed: SILCALIVF (KKLC1_HUMAN)
STLCALIVL

SEQ ID NO: 39335 - protein, 11 aa, Artificial Sequence
  Description of Artificial Sequence: Synthetic peptide
  Seed: RQKRILVNLSM (KKLC1_HUMAN)
RDKRILVNLSL

SEQ ID NO: 39336 - protein, 9 aa, Artificial Sequence
  Description of Artificial Sequence: Synthetic peptide
  Seed: KYRRFQRNT (KKLC1_HUMAN)
KGRRFQRNK

SEQ ID NO: 39337 - protein, 9 aa, Artificial Sequence
  Description of Artificial Sequence: Synthetic peptide
  Seed: ASSILCALI (KKLC1_HUMAN)
AISILCALV

SEQ ID NO: 39338 - protein, 10 aa, Artificial Sequence
  Description of Artificial Sequence: Synthetic peptide
  Seed: YLLLASSILC (KKLC1_HUMAN)
YHLLASSILA

SEQ ID NO: 39339 - protein, 9 aa, Artificial Sequence
  Description of Artificial Sequence: Synthetic peptide
  Seed: KGFRGASPH (KKLC1_HUMAN)
KQFRGASPF

SEQ ID NO: 39340 - protein, 10 aa, Artificial Sequence
  Description of Artificial Sequence: Synthetic peptide
  Seed: KGFRGASPHR (KKLC1_HUMAN)
KCFRGASPHR

SEQ ID NO: 39341 - protein, 9 aa, Artificial Sequence
  Description of Artificial Sequence: Synthetic peptide
  Seed: MVENKLVEL (KKLC1_HUMAN)
MWENKLVEM

SEQ ID NO: 39342 - protein, 9 aa, Artificial Sequence
  Description of Artificial Sequence: Synthetic peptide
  Seed: LVRPSSSGL (KKLC1_HUMAN)
LPRPSSSGC

SEQ ID NO: 39343 - protein, 9 aa, Artificial Sequence
  Description of Artificial Sequence: Synthetic peptide
  Seed: MSSNSTALA (KKLC1_HUMAN)
MSSNSTALK

SEQ ID NO: 39344 - protein, 10 aa, Artificial Sequence
  Description of Artificial Sequence: Synthetic peptide
  Seed: EHTLLSKGFR (KKLC1_HUMAN)
ESTLLSKGFR

SEQ ID NO: 39345 - protein, 11 aa, Artificial Sequence
  Description of Artificial Sequence: Synthetic peptide
  Seed: YLLLASSILCA (KKLC1_HUMAN)
YVLLASSILCI

SEQ ID NO: 39346 - protein, 11 aa, Artificial Sequence
  Description of Artificial Sequence: Synthetic peptide
  Seed: RQKRILVNLSM (KKLC1_HUMAN)
RDKRILVNLSR

SEQ ID NO: 39347 - protein, 9 aa, Artificial Sequence
  Description of Artificial Sequence: Synthetic peptide
  Seed: VELEHTLLS (KKLC1_HUMAN)
VELEHTLLM

SEQ ID NO: 39348 - protein, 9 aa, Artificial Sequence
  Description of Artificial Sequence: Synthetic peptide
  Seed: LASSILCAL (KKLC1_HUMAN)
LMSSILCAT
